United States Patent 10,279,031 (COMPOSITION COMPRISING ANTIGENS AND A MUCOSAL ADJUVANT AND A METHOD FOR USING) - sequence listing, part 3

SEQ ID NO: 3 - DNA, 2146229 bp, Streptococcus suis
gaaccaagaacaacttttttggcaacgatttattgaattggcaaaggtaaattttaagccatctatttatgatttttatgtcgctgatgcaaaattactcggaatcaaccagcaagttgccaatattttcttaaatcgtccatttaaaaaagatttctgggaaaaaaacttcgaagagttaatgattgccgctagttttgaaagctacggagagcctcttaccatccaatatcaatttacagaggatgaacaggagattaggaatactacaaacacaagaagttcaatagttcaccaggtacagacacttgagccggctactcctcaagaaacttttaaaccggttcattctgatataaaatcccagtacacctttgctaattttgtacaaggagacaataatcactgggcaaaggctgcagctttagctgtatctgataacctaggtgagctctacaatccattattcatttttggtggtcctggtcttggaaaaactcatattttaaatgcgattggaaataaggttctagccgataatccccaggcaaggataaaatatgtctcatcggaaacattcatcaatgaatttttagaacacctccgtctcaatgatatggaaagtttcaaaaaaacctatcgcaatctggacttacttctaattgatgacattcagtctctccgtaataaagcaacaacacaggaagaatttttccatacttttaatgcgcttcatgaaaaaaataagcagattgtactcacaagcgaccgtaatcccgatcacttagacaatttggaagaaagactagtaacacgtttcaaatgggggttaaccagtgaaatcactccacctgattttgaaacacgtatcgcaattttacgtaacaagtgcgagaacctgccttacaactttacaaatgagacgctatcctatctagctgggcaatttgattcgaacgtacgtgaccttgaaggtgccttaaaagatatccatttgatagccactatgcgtcaactgtctgagataagtgtcgaggttgctgctgaggctattcgatcaagaaaacaaacaaatccacaaaacatggttattcctattgagaaaatccaaaccgaagtgggaaatttctacggtgtcagcttgaaagaattaaaaggttctaagcgtgttcaacatatcgttcacgcgcgacaagttgctatgtttttagcacgtgaaatgacagacaattcccttccaaaaattgggaaagaatttggtaatcgagaccatacaaccgttatgcatgcatacaataaaataaaaactctcctcttggatgatgagaatttagaaatagagattaccagtataaaaaataaacttcgttaacctgtgtataacttttttaaaaaactctgttttttccacaagttgtgaacaagttaatttccgcagttttattggtctttcatcacttttccacagaatacacagagactactattactattaaccttatagataataaataaaggagaatccatgattcaattttctattaataaaaatatatttctacaagcacttagtattactaaacgggcaatcagtacaaaaaatgctattccaattctttcaacagtaaaaattacagtaactagtgaaggaatcactttaactggttcaaatggacaaatctcgatagaacattttatttctattcaagatgaaaatgcagggcttttgatcagttctccaggttccattctcttagaagctggtttctttattaatgtcgtatccagtatgccggatttggtccttgacttcaatgaaattgaacaaaagcaaatcgttttgacaagtggtaagtctgaaatcacattaaagggaaaagaagcagaacagtatcctcgtttacaggaagttccaacttcaaaaccattggtgttagaaaccaaagtattaaaacaaacaattaatgaaacagcatttgcagcttctacacaagaaagtcgtcctattcttacgggtgttcattttgttttaacagaaaataaaaatctaaaaactgttgcaacagattcacaccgtatgagccaacggaaattggtccttgatacctctggtgatgattttaatgttgtcattccaagtcgttctctccgtgaatttactgcagtttttacagatgatattgaaacagtagaagtcttcttttcaaataatcaaatcctttttagaagcgagcatattagcttctatacacgcttattagaaggtacctaccctgataccgaccgcttaattccaactgagtttaaaacaactgcaatttttgatactgcaaatcttcgtcactcgatggagcgtgctcgtcttctttcaaatgcaacccaaaatggtacagtaaaactagaaattgctaataatgttgtatcggctcatgtaaattctccagaagttggacgtgtgaatgaggaattagatactgtagaagtatcaggtgaagatttagtaatcagctttaacccaacttacttgatagaagcattgaaagccacaactagtgaacaagtgaaaattagctttatctcttctgtccgtccatttacattgattccaaataatgaaggggaagattttattcaattggttacaccagttcgtaccaactaaataatattaagaacggctaaactagccgtttttatgttatactaaaaaatagcacctagcttatttttatatatttagtgatggggaataaatgacgttatatatattagctaatcctaatgctggtagccatactgctgaacatatcatattcaaaataaaagaaagttatccacagcttgcagttaacatttttatgacagttggtcctgaggatgaaaaaagtcaaatagaggctattttaaaggagtttgtcagtagtgaagatcaattaatgattttaggcggagacggcacactatctaaagctttgcgtttttggccagctagtctaccgtttgcttattatccaacaggatctggaaatgattttgctaaggcaatgaatataacatcgctatatagaagtgtagatgccattttagagagaaaaacaagtcggatatatgttttaaacagttcatacggaacggttgtaaacagtatggattttggctttgcagctcaagttatcaatggttcaacgaattcaattttgaaaaaaattctgaacaaggtaaaacttgggaagttaacttatctattctttggtattaaaacattattttcaaaacaagctataaacttagaattaactcttgatgaaaaatcttatcagttagataatctcttttttatttctgtagcaaatagtctttattttggtggaggaatcatgatatggccaacagcaagtgctaaaaagaaggaagtagatattgtttacttcaaaaatggaaatttctaccaacgtctacaatcattgttagccttattaacgaagaggcatgaatcttctcatacgattcagcatttaacaggggtagatgtagttttaaaatcaaaagaaaaattattattgcaaatagatggagagacatgcactgcaaatgaggtaacgttaacctatcaggaaagaagtatgtatctttaaggaggaagtatgtaccaattaggaacctttgtcgaaatgaaaaagccccatgcctgtgtcatcaaatcgaccggaaagaaggctaataaatgggaggttatccgtctaggagcggatattaaaatccgctgtaccaactgtgaccatgtcgttatgatgagccggcatgattttgaacgaaaaatgaaacaagttctgccaagtgaagcctagttgacagtttgcaactactggttgcgaatttttcctaaaaagtgctagtcaactgttcctttctaaactataatagacttagaaaaaagaggaggaaatgatcatgaagcagttagcacagcaaattcgagttttacgcacagccaagaacctatcccaagatgagttggcagagaaactctatatttcccgtcaggctgtttccgagtgggaaaatggtgaagccacaccagatattgacaaactggtccagctggcagaaatctttggtgtcagtctggattatctggttttagggaaagaacctgagaaggaaattgtggtggaacaacgaggaaaaatgaatggttgggaattcttgaacgaagaatccaaacgacctcttacaagaggagatgttgtccttctcatttttcttgcagttatgcttttaggtggattatttattaagcattatttttaacgaagcttgccaaacagcaagctttttctctacttttctgctataatagtcatgattgaatttttaattggagagtaaaaaaaacatgtctttaacagcaggaatcgtcggtttgccaaacgttggtaaatcaaccctatttaacgcaattaccaaggcaggagcagaagctgcaaactaccctttcgcaactattgatccaaacgtcggcatggtagaagtgcccgatgagcgtctgcagaagttgaccgaactcatcatccctaaaaagacagtgccaacgacttttgaatttactgatattgctggtatcgtaaaaggtgcttctaaaggtgaaggacttggaaataaattcttggccaatatccgcgaagttgatgcgattgtccacgttgtgcgtgcctttgacgatgaaaatgtcatgcgtgaacaaggccgtgaagatgcctttgtggatccaatcgctgatattgataccattaacctagaattgattttggcggacctagagagcatcaacaagcgttatgcgcgtgtagaaaaaatggcccgtacgcaaaaagacaaagattctgtcgcagaatttgcagttcttgaaaaaatcaaacctgtcctagaagacggaaaatctgcccgcacagttgagttcacagatgaagaacaaaaaatcgttaagcaactcttcctcttgaccactaaacccgtcctctatgttgccaatgttgatgaagacaaggtagcagatcctgaggctatcagttatgttcagcaaatccgtgactttgcagcaacagaaaatgcagaagtggtggtgatctctgcgcgtgctgaagaagaaatttcagaactcgacgatgaagacaagggcgagtttttagaagcactcggattaacagaatctggcgtggacaaattaacacgtgcagcctatcacttgcttggtctaggcacctactttacagcaggggagaaggaggttcgtgcttggaccttcaaacgtggtatgaaagctcctcagtgtgcaggcattatccattcagacttcgaaaaaggttttatccgtgccgttaccatgtcatacgatgatttaatgacctacggctctgagaaggctgttaaagaagcaggacgccttcgtgaagaaggaaaagagtacgtggttcaagatggggacatcatggagttccgctttaacgtttgattgctaaactgtccttattcttcgttgttttaccttgccataccatcagtattgtctgcggtttcaacgcctagactaagaacagtttatcgcatcaaagaggatgattacttggttggaaagctttttccagccttttggtatttaaggagaaaaaatgacacgattgattatcggtttgggaaatcccggagaccgctattttgaaacaaaacataacgttggttttatgctgctggataagattgctaagcgtgaaaatgtgacctttaaccacgataagattttccaagcagacattgccacaacctttattgatggtgaaaaaatttacctggtcaaaccaacgactttcatgaatgaatcaggtaaggctgtccatgccttaatgacttattatggtctggatgcaactgatattttagtagcttatgacgacttggacatggctgttggaaaaatccgtttccgtcaaaaaggctcagctggtggccacaatggtatcaaatccattgtcaagcatattggaacacaggaatttgaccgtatcaagattggtattgggcgtcctaaaggaaaaatgagcgttgtaaaccatgtcttgtctggctttgatatagaggaccgtattgaaatcgacttagcactagataaacttgacaaggctgtcaacgtatatctcgaagaagatgattttgatacagtaatgagaaagtttaacggataatgaatatactcgatttacttcacaagaacaagcaaatcaatcaatggcagtcaggattgaatcaatcaacacgtcagttattattaggactatctgggactagtaagtcacttataatggcgactgcctatgattgtttggccgaaaagattatgattgtgactgccactcaaaatgatgctgagaaattagttgcagatttaacagccattattggaagtgagaatgtttacaacttttttacagatgatagtcctattgccgagtttgtttttgcatcaaaagaacggactcaatcaaggattgacagtttaaatttcttgacagattctaccagttcaggaattttagttgctagtatagttgcttgtcgggtcttattgccgagtcctgagacttataaaggttctaaaatacagcttgaagttggtcaagaaatagaagttgacaaacttgtaaagaaccttgtcaacatcggctacaaaaaagtgtctcgtgtattaacccagggagaatttagccaacgaggtgatattctagatatttttgacatgcaatcagaaacaccttaccgaatagaattttttggagatgagattgatggcattcgtatctttgatgttgacagtcaaaaatccttagaaaatctagacgaaatctcgatctctccagcttccgatatcattttgtcttcagaagactatagtagagctagccaatacattcagacagctattgaacaatcgactctagaggagcaacagtcttacttacgagaagtcttagctgatatgcagacggagtaccggcatccagatttgcgtaaattcttgtcctgtatctatgaacaatcatggacattgttggattacttgccaaagagttctcccttatttttggatgattttcataaaatcgctgataagcaggctcaatttgaaaaagaaattgcagacttgttgacagatgatttacagaagggtaaaacagtgtcaagtttgaaatattttgcctcaacttatgctgaattgagaaaatacaaacctgccaccttcttttcaagttttcaaaaaggtttaggaaatgtaaagtttgatgctctttatcaattcacacagcatcctatgcaggaatttttccaccagattccactgttaaaagatgaattgactcggtatgcgaaatcaaacaataccgttgttattcaagcgagttctgatgtaagtttacagactttacagaaaaatttacaagagtatgatatccatcttccagtacatgcagcagataagttagtagaaggtcagcaacaggttacgattggtcagttagcttcaggttttcatttgatggatgagaaactagttttcatcactgaaaaagagattttcaataagaaaatgaagcgtaagacacgtagaaccaatatttctaacgctgaacgtattaaggactatagtgaattagcagttggtgactatgttgttcaccatgttcatggtatcggtcaatacttaggaattgagactattgaaatttcaggcattcatcgtgattatttaacggttcaatatcaaaactccgatcgcatttctattcctgtagaacaaattgatcttctctccaaatacttagcgtccgatgggaaagctccaaaagttaataaactaaacgatggccggttccaacgaaccaagcaaaaagttcagaagcaagtggaggatattgcagatgatttgattaagctttatgcggagcgtagtcagctgaaaggctttgccttttcacctgatgatgaaaatcaagttgaatttgacaactactttacacacgtggaaaccgatgaccaactccgttccattgatgaaatcaaaaaagacatggaaaaagactctccaatggaccgtctgttagtaggagatgtcggatttggtaagacagaggtagccatgcgcgctgctttcaaagcagtcaatgatggcaagcaagtagctattcttgtacctacgactgttttagcccagcaacactatgctaatttccaagaacggtttgcagaatttcccgtcaatgtggatgttatgagtcgttttaaaacaaaggcagagcaggaaaaaacacttgagaagttgaaaaaaggccaagttgacatcttgattggtacccatcgccttctatcaaaagatgttgtttttgctgatttaggtttactggttattgacgaagagcaacggtttggtgtcaagcataaggaacgcttgaaggaactgaaaaagaaaatagatgtcctaaccttgactgcaactccgattcctcggacattgcaaatgtccatgctgggaatccgcgacttatcagtaattgagactccaccgacaaatcgctatcctgtacaaacttatgtgatggaaacaaatccttccgttatccgagatgcaatgcttcgagagatagatcgcggaggtcaggtttactatctttacaataaagttgataccattgaacagaaagtgtctgaattaaaagaattggttccagaagctactataggatacgtccatggacaaatgtcggagatccaattagaaaatactctctatgcttttgtagagggtgaatatgatattctagtgaccacaacaatcatcgaaacaggtgttgatattccaaatgctaatacactgtttattgaaaatgcagatcatatgggactgtcaactctttatcaacttagaggacgtgttggccgttccagtcggattgcctatgcctatctcatgtaccgtccagacaagtccttgacagaagtagctgaaaaacgtttggaggcaatcaagggctttacagaactaggatcaggtttcaagattgccatgcaagatttgtccattcgtggtgcgggaaatattttaggtgctgctcagtcaggttttattgattctgtgggatatgagatgtattcacaattgctggaacaagctatcttggaaaaacaaggtaaggcaacccaacgtcagaagagtaattccgaggtcaatttacagattgatgcctatttaccaagtgattatattggtgatcagcgacaaaaaattgaaatttacaagcgtataaagaatattgacagtcgtgtcaactatcaagaattgcaagaagaattgattgaccgttttggagagtatcctgatgtagtagcctacttgcttgaaatcggtctactgaagtcatttttagaccaagttttctgtcatacagttcttagacgacaacatcaagtgacagtaacattcgaacctatggctggtcaaattttcctaacgcaagattactttgaagctttatctgtgacaaatttgaaagctcagataacggaaaataaaggaaaactagctgttgtgtttaacattcaacagaaaaaagaatatgaaatattagaggaattgatttcttttgccgaaaaattaaaagaaattaaagcaaggaaggcagaataaatttctcaaataccttgaaaaatggtaaaataatgaactgaggtaaagtatgagactagataaatatttgaaagtatcccgcattatcaagcgtcgaacagttgcgaaggaagttgccgataaaggacgaataaaagtcaatgggattttggcgaaatcttcaacagatttaaaagtaaatgatcaggttgaaatccaatttggtaataaactactcactgtaaaagtacttgaaatgaaagattcgactaaaaaagaagacgcactgaaaatgtatgaaattatcagtgaaaaaaggatagaaaaagatgaagaaatctaaaattctacaactgaataatgcctttattcagtcggagcgtaaaaaaactcagcatcaattggcagaacgccaacaaaaaaatcgttttatgggtgcaattctcattctagttatctttctttttatgttgcctgcctataatcttgttgggacttacactaatattcagcagcaggaaaagaaacttgctgaattggaaaaaaattacgaagaactgaccaaagaacagaagcaggaagcagagatggttgcaaaattgaaaaatgaggaatacgcagcaaagtatgttcgggctaagtatcaatactctaaagaaggggaatttgtctacaatattccagggttaccaaaatgaccgaatctatttttaaaattgtagagcaatttttacagcattctgatgaaaaattagaagagttgaatcaaaagaatagagaattaaagttagaagaaaatgaatcgtagaaaggagggagtatgcagaaaaaactgctcgtatggttattgccagttttatttggatggcaggtggtcgatagtacagaaataccatttgaactcacagcgcaagaagaatacgaattgactcatactatctatgatcagtattttcaaactatccctcaaaacccaaatgtttttcaaactgagaatctttattcggatgaagaattgactatagcaggtggacaattacagccgaaccaacatttttctattacggatgttctagtcaatagcaaaaaagaattggttttccaaatagatgacaagggttacattcttgcaagtaggcatctactatttgatgatgtaattgttacagaaactactgttgagcaaacttattggacaaaaaaaggtttcacattgttaacctcaccaattgctaacgaagctacggaaataaaaaatgatttacaaccctatcaagctgttatggtttctaaaattgtgacaacttccctaggtgattttgcctatgttacagataaaggttggattgcagtaaataatctttctaaaacggataatagagtagaagccgttcaagagttgttgactaacaaatattccaaagatactattggtatatatgtgaaacaattgtcaacaggtcaaactgcaggtgtaaatcaagagaaactattctattctgccagcattgctaaactaccaattctttattacgttcaagagcaactgaatgctggatatattgatttgactactaaagtgaaatatacagccgaatctatatccttcccaggagcttatgttgctggaggaagtggttcactgtcaaaaactcctgacaacaaagattattcagtggaagaattgatcaataagactgctaaagagtcagataatgtagctagtaatttactttcttattatgtagctaataaattcgattctaatttttatcaagtaataactgctaaaacaggtagtgagtggagtatggttacacgtgaaacttcagctgagattgcagggaaaatgatggaagccttatatattcaaaatggctatgtgctagaaagtttgttatctactcaatttgataatcaacgtatttcgaaagacatctcagttccagttgctcataaaattggcgatgcagacgatgtcaaacacgatgtagcgattgtttacgcagggtctccctttgttttatctatttttacagataaatcaaattatgatgagattacacaaattgcaaatgatatttacaggattttaaagtaaatgaaagatagatttttaaaagtgacactggatggtcacttttttgataaacataagaaagtactagtagccgtatctggtgggttagattctatgaacctattccatcttttatacgaatgcaaacaagtgttagggattgaacttggaattgctcatattaatcatggacagagagaagaatctgtcattgaggaaaaatatcttagacagttagcagaagaaagtaatgttcccttttatctgtcctattttgaaggtgttttttcagaagaagcggcgcgaaaatggcgttatggattttttgctacaatcatggagaaggaaggctacactgcactagtgacagcccaccatgcagatgatcaagcagaaactgtctttatgcgattgattagaggcgggcgtttacgtcacttatcagcaattcaaccgactcagccttttgcaacaggggaacttattcgaccacttttatcttttaaaaaggcagattttgaaaagctatttcattttgaagattgcagcaatgcagatttcaaatattttcgaaatagagtcagaaatgactatttaccaaagttaaaacaggaaaatcctaaaatcgaacttactctcaataatcttgcagttgatacaaataatctatttcaagcgctaagagatttgacacaggatttatccgttacagatgtgatgagttttcaacaacagacacctgcggtacaaagttatctattagaggaatatttggaaaaatttcctgatttacagctctctcgtccacaatttaatgaagtattacacatcttgcgttcaaaagctaactactatcatttattgaaaaatgattacatgctagaaaaggattatcatcgttttcaaatttataaaataggaccagagacggatagtcaaccagaaaaaatcatgatagaatcagaggggattttttcttacggttcatatattttttctctcaatcatcctttggaagaagcggatagtattttatattttcctacagaaaatccaattgtagtgaggagaaggcaggctggggataccattttaataaacggagtaaataaaaaactccgccgttggtttattgataataaaatctcacagaaagttcgacaaaatgcgcttattatcgagcagaatggagaaatttatggaattacgaatcttgttagcagtgatttgagtaaatcagtaaaaaatgatataatcaaagctaccttatatataaaaatgaaagagtagaacaactatgttggacaaagatattaagaaaattcttgtttcagaagaagaaatcgttgcaaaatgcaaagaactcggtcaaattctagcaacagactatgcagataagaatcctattcttgtaggaattttaaaaggttctatcccatttatggcagaattaatgaaacatattgatgcccatgtagaaacggattatatggttgtttctagctaccatggcggaacggagagttgtggtaccgttaagattatcaaggatttggacaatagtgttgcaggtcgacatatcatcttcgtagaggatattattgacactggtcgcacattaaaagaattgaaagaactctttgctttgcgtcaggcagcttctattaaaattgccactcttcttgataaaccagaaggtcgtgttgttgaaatcgagccagactacacttgctttactattccaaatgaatttgtagttggatttggcttagattatgatgaaaattatcgtaatcttccttatgttggtgtactcaaagaggaagtttacacaaaatagaaaaaggtttcctactatattatgaacaatcaaccaaataaaggatttataaaaaatccttttctcattattctcgttattgccactattgttacagcctttcaattttttaacgctggtcagcaagtagcaactcaagaaatcagttattcacaagtagtaactgaattgaaaaataataatgtatctgaaattacttatcaaccaaattcaagtgttattgaaattactggtaagtacaaaacagaacaggaagctaaagatgagttagcttcatctattaagttattccaagtttctagtaaagttaagtataaaaactttaagtcgctaattttaccgtcagaaacgaatttgtcagagctacaagctcttgcaaatgaaaatggagtaaaggttgctattaaacctgaaagttctaatggactatggttgaacattatctttaatttgttgccacttgttattgctggtgtattcttcatgatgatgatgaaccagggtggtggtggagcacgtggtgcaatgaactttggacggaataaagctaaagctttggaacaaagtaacatcaaggtacgtttctcagatgtagcaggtgcagaggaagaaaaacaagaattagttgaagttgttgaatttttgaaggatccaaaacgctttactaaacttggagcacgtattccagcaggtgtgctactagagggtcctccaggaaccggtaaaaccttgcttgccaaagcagtagcgggtgaagcgggtgtaccattcttctccatttctggttcagattttgttgaaatgtttgttggtgtcggtgccagccgtgttcgttcattatttgaagatgcaaaaaaagcagcaccagccattattttcatcgatgaaatcgatgctgtcggtcgccaacgtggtgtcggcatgggtggcggtaacgatgaacgtgaacaaaccctcaaccaactcttaattgaaatggatggttttgaagggaacgaagggattattgtcattgccgcaaccaaccgtagtgatgttttagaccctgcccttcttcgtccaggtcgttttgaccgtaaggtattggttggtcgtccggatgttaaaggacgtgaagcaatccttaaagttcatgcgaagaataaaccactagcagcagatgtagatttgaaattagtagcacaacaaacaccaggatttgttggtgcagatttagagaacgttctgaacgaagcagcccttgtagctgcacgtcgaaacaagactgtcattgatgcttcagatattgacgaagcagaagatcgtgttattgcaggtccatctaagaaagaccgtcaagtttcagccaaagaacgcgaaatcgttgcctaccatgaagctggtcatacgattgtcggccttgtcttgtcaaatgcacgtgaagttcacaaagtaacaattgttccccgcggtcgcgcaggtggatacatgattgcccttcctaaagaagatcaaatgcttctttctaaagaagatatgaaggagcaattggctgggcttatgggtggtcgtgttgcggaagaaattatttttaatacacagaccacaggagcatcaaacgacttcgagcaagctacacagatggcgcgtgctatggttgctgaatatggtatgagtgacaaaatgggaccaatgcagtatgaaggcagtcatgcaatgtttggtggacaaacaactcaaaaacatatttctgagcaaactgcatatgagttagataatgaagtacgtgatttgttaaatgaagctcgcaacaaagcggctgaaattattcagtctaatcgcgaaactcataaactaatcgcagaagcattacttaaatacgaaaccctagacagtgttcagatcaaatctctctatgaaacaggcaaaatgccagagaatattgaacgtgatgatgaagatgttcatcccctttcttatgaagaggtaaaagagaaaattaatacgaaagagtagtataaaaatactcttggcaagacattccctcactctcaaccactaaaataaccacaaagccttcgctaagtacataatcttggcgagggcttttttacatgatacacatcagaaacagggcatttacaagaaaaacgaatcaatagttatttatcacaatcttagaactataccaaatcactcccttcagaagcagaatgcaatatttgccatagagtatcaatagcaaatgtactttaaaaaagaaaaatcaaataaagtatgctagacaaaaatgtcctgtagaaagacagcacttttcgataaacttaaaccatcaacaaaaggagattaagtaatggaattcgaaaaagtgtacgcaagcgtcaaaggtattgtaaacaaggctcgaaaagagttttacattaaactatgggatcgagatgattgggaacaagaaggaatgatgaccttgtttgaattgttggaagctcaaccgtggctagttgatgaacaagttcaattatattgttattttaaagtcaagttcagaaatcgaatcaaagatcgtatccgcaaacaggaaagtcaaaaacgcaagtttgaccgtatgccacatgaagatatttacgaattatctcacgcaatacaatcaccgggattgataaacgatgaattattaatgttgagaggtgccttgagagattatcgaaaaaatctgagcaatgatcaacttgataaatacgaaaaattaattagcggacaatgttttaatggtcgccgtgaaatgatacgtgatttacaaattcatttgaaagactttcgctaaagctagttactaacatcacgttaatcgaattaagaaattgggcagaagcaccataaaaagttctgttcagtttctttttagataggttatagcacaggaagaaggaataggagaaaaaacaaagtatctacatagaactttcagtgtaaaaaatcccaaaaaaccggttgacaattgccaaagtagatgatagaataaatgagttgtctcttgagggactagttaacagaggaacgaaaaaagtttcgaaaaagtgttgacaagaccatcagaagatgatagactaatagagttgtctcttgagggactggttaacagaggaacgaaaaaaagtttcaaaaaagtgttgacaaagttcacaagaaatgataaactaagatagttgtcgcgagagcgcgataacgacaagacctttgaaaattaaagaagacgaaccaaacgtgcagggtgatttatctaaagataaatcgtcaatgacaaaacaaaacaataaaacggaaagctagcaatagcttgagtttgaatcaaaactttttatgagagtttgatcctggctcaggacgaacgctggcggcgtgcctaatacatgcaagtagaacgctgaagtctggtgcttgcactagacggatgagttgcgaacgggtgagtaacgcgtaggtaacctgcctcatagcgggggataactattggaaacgatagctaataccgcataacagtatttaccgcatggtagatatttgaaaggagcaattgcttcactatgagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaactgtgagaagagtggaaagtttctcacttgacggtatcttaccagaaagggacggctaactacgtgccagcagccgcggtaatacgtaggtcccgagcgttgtccggatttattgggcgtaaagcgagcgcaggcggtttgataagtctgaagtaaaaggctgtggcttaaccatagtacgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgaccgccctagagatagggtttctcttcggagcatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaaatggaaacctgtacgtcagtcttctttaattttgagaggtcttgtggggccttagctcagctgggagagcgcctgctttgcacgcaggaggtcagcggttcgatcccgctaggctccattaacaacggaagttgttaagattttgtccattgaaaattgaatatctatcaaacattcctaaacgtatgtaaaagtacgtatagaaatagtaacaagaaaataaaccgaaaacgctgtgaatatttaatgagttttctaatttttgaaaaaattaggttaaaacaagttacgaagacgttaaggaaaacgtatgattttaggaaatcatcgcagtagtctaaggactacaagaggatttgtctaaatcactagttttctagtctgagtacgattataaggttaagttaataagggcgcacggtggatgccttggcactagaagccgatgaaggacgtgactaacgacgaaatgccttggggagctgtaagtaagcaatgatccagggatgtccgaatgggggaacccggcaggtaatgcctgtcactcactactgttaaggtagtgaagaggaagacgcagtgaactgaaacatctaagtagctgcaggaagagaaagcaaaagcgattgccttagtagcggcgagcgaaacggcaggagggcaaaccgaggagtttactcctcggggttgtaggactgcaatgtggacttaaagagtatagaagaactacctgggaaggtaggccaaagagagtaatagcctcgtatttaaaatattttttatacctagcagtatcctgagtacggcgagacacgcgaaatctcgtcggaatccgggaggaccatctcccaaccctaaatactctctagtgaccgatagtgaaccagtaccgtgagggaaaggtgaaaagtaccccggaaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcggattagtattatgtcgtagacccgaaaccatgtgacctacccatgagcaggttgaaggtgcggtaagacgcactggaggaccgaaccagggcacgttgaaaagtgcttggatgacttgtgggtagcggagaaattccaaacgaacttggagatagctggttctctccgaaatagctttagggctagcgtcgacatttgagaatcttggaggtagagcactgtttggatgagggggccatctcggtttactgatttcagataaactccgaatgccaatgatttatggtcggcagtcagactgcgagtgctaagatccgtagtcgaaagggaaacagcccagaccaccagctaaggtcccaaaataattgttaagtggaaaaggatgtggggttgcacagacaactaggatgttagcttagaagcagctattcattcaaagagtgcgtaatagctcactagtcgagtgaccctgcgccgaaaatgtaccggggctaaaacaatttaccgaagctgtggataacactttagtgttatggtaggagagcgttctatgtgtgaagaaggtataccgtgaggagtgctggaacgcatagaagtgagaatgccggtatgagtagcgaaagatgggtgagaatcccatccaccgtaagactaaggtttccaggggaaggctcgtccgccctgggttagtcgggacctaaggagagaccgaagggtgtatccgatggacaacaggttgatattcctgtactagagtatgaagtgatggagggacgcagtaggctaactaaagcgggcgattggaagtgcccgtctaagcagtgaggtgtgatatgagtcaaatgcttgtatctgtaacattgagctgtgatggggagcgaagttaagtagcgaagttagtgacgtcacactgccgagaaaagcttctagcgatgtatcatactctacccgtaccgcaaaccgacacaggtagtcgaggcgagtagcctcaggtgagcgagagaactctcgttaaggaactcggcaaaatgaccccgtaacttcgggagaaggggtgctggcttaaagtcagccgcagtgaataggcccaagcaactgtttatcaaaaacacagctctctgctaaatcgtaagatgatgtatagggggtgacgcctgcccggtgctggaaggttaagaggagggtttagcgcaagcgaagatctgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctacgaagtcgggacgccagtttcgactgaggcgctgttgggatactacccttgtgttatggctactctaacccggataggttatccctatcggagacagtgtctgacgggcagtttgactggggcggtcgcctcctaaaaggtaacggaggcgcccaaaggttccctcagaatggttggaaatcattcgcagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggacgggataaacgctgaaagcatctaagtgtgaaacccacctcaagatgagatttcccataactttatgttagtaagagccctgagagatgatcaggtagataggttggaagtggaagtgtggcgacacatgtagcggaccaatactaatcgctcgaggacttatccaaagaaataaactagagtcaatattgacaagcgatcggtttcttgttagaatatagatattcaattttgagttgacaagactcagtagttaagtgacgatagcctaggagatacacctgtacccatgccgaacacagcagttaagccctagaacgcctgaagtagttgggggttgccccctgttagatacggtagtcgcttagcaaattgggagtttagctcagctgggagagcatctgccttacaagcagagggtcagcggttcgatcccgttaactcccataggtcccgtagtgtagcggttatcacgtcgccctgtcacggcgaagatcgcgggttcgattcccgtcgggaccgttgaaacgaatcaatcatatgtttcaagtaatataattaagtaaagactcgttagctcagttggtagagcaattgacttttaatcaatgggtcgctggttcgagcccagcacgagtcatatgcgggtttggcggaattggcagacgcaccagatttaggatctggcgctttcgggcgtgggggttcaagtcccttaacccgcatagaatggaaataggccggcttagctcagttggtagagcatctgatttgtaatcagagggtcgcgtgttcaagtcatgtagccggcattaggaaagattgcgaacgtagttcagtggtagaacaccaccttgccaaggtgggggtcgcgggttcgaatcccgtcgttcgctttgagaggccggggtggcggaactggcagacgcacaggacttaaaatcctgcgatggcaacatcgtaccggttcgattccggtcctcggcatgaagattataatagttagcacccttagctcaactggatagagtacctgactacgaatcaggcggttagaggttcgaatcctctagggtgcatcactcgcttaatggagacgttaggggagctttatttttaatagtatcgggaagtagctcagcttggtagagtacttggtttgggaccaaggtgtcgcaggttcgaatcctgtcttcccgattatattattttggcggtgtagctcagctggctagagcgtccggttcatacccgggaggtcgggggttcgatccccttcgccgctatatactcttgtttgctggacctttagctcagctggttagagctctcggctcataaccgagcggtcgtaggttcaagtcctacaaggtccatatatcggaggattacccaagtccggctgaagggaacggtcttgaaaaccgtcaggcgtgtaaaagcgtgcgtgggttcgaatcccacatcctccttttctactaccgcgggatggagcagctaggtagctcgtcgggctcataacccgaaggtcgtaggttcaaatcctgctcccgcaatttctttaagaatttggctcggtagctcagttggtagagcaatggattgaagctccatgtgtcggcggttcgattccgtctcgcgccattaatttaactttgtccaagtttattatcttgggcgcgtagctcagatggttagagcgcacgcctgataagcgtgaggtcggtggttcgattccactcgtgcccatattatattgatggagaattactcaagaggctgaagaggacggtttgctaaatcgttaggtcgggtaactggcgcaagggttcgaatcccttattctccgtagtgaacgagattatcgcttgatattctcgttttattgtatcttggtgaggatatattatgaataaattttcaaaattagtagtagttgtttctatctttttattactgtcattttctcttttgtttgtgactttctctaaggggttacaggtaccatatttaaataatatcgttagggttgttgtaacgccaattcaatcggttatttcagtacctactagatttttttctgagcagaaagatgtcttgacagatttgatgaacgcttacgaggaaaataaacaattaaaggaaactattatgagccttgaagggatggctgctgaaaatactagcttgaaagaagagaatgcatcgcttcgtagcagtttaggtgtggtatctgattttcctgaaaaacaacttattccgggatcagttttagtgaggactccttcatcgtggtcggagcatatttcaattaatattggtgagactagtggtgtgacatataatgcacttgtggttgctaatggtggattagttggcatcgtgagttcattgagttcagattcggcggttgttaccttatttacgaattcggatgaattcacgaagttacctgtgaaaatttctgttgattctaaagaaatttatggtattttatcgggctatgatgcagatacaaatagttttatcattaatcagttgaactcagctgatgaaattgcagtgggtagcaatgttgtaacgagtgatttggctggtgcgactccggcaaatgtccaaattggtaaagttttatcggttaaatcaaatagtaacagtttaaatagagaagtatatgttgagccgacagctagtttttcaaacatttattcggttttagtggtaggtcaaacaaatgcgcaataaaatgatagaaatattcatgtttcccatcttgttctttattttattacttgatggacagatttcaacgttggtaacaaattggtcggtcggattatttactatttcaagtcatttggtacttatgttagctattttttatgctaactatgtatctcttggtttttcattattcatatttactttgctaggtttggtatatgatattagttatcttaatctgattggtattgctactacaactcttcctttagttttatattgcatctatttcttctttcaaggtgctgtcagcaagcgaggaattaatattttgattttactagtagctatttttcaatttgaatttattagttattcatttgctcgtatttttcatataacaaacttgtctgtatttatctttgtttttaataaattacttccaagtttactattcaatttggtcttatttttcgtgttacaaccattatttgagcgtttatttggaataacaaacaagacatagaaatgtaataattgcgtaatatacttacgcgatttttttgataaaatgagagagtcagaaagtatagaggagttatgttcggatatgaagaaaaaaatcttggctacaattatgttaagtacagtcgttctatctaatgctaattatgtagctgtgattagtgcgaatgatgtagatagtcagattgcaacaaaaaatcaacagattagtgagttgacagcacaacaagcagaagctcaacaacaagttgatgctattcaaggacaagttgatgcaattgttagtgaacaggcgaaattaacagaagaaaatactcgtttggaagcagaatcgcagacattggcggcagatattgagcgtttgtcagctgatattgtgtcacgtgatggtgctttaaaggagcaggcgcgtagtgctcaagttgatggttctgcttcaagttacattaatacaattttggattcaaaatcaatcattgatgctgtttctcgtgttaatgcaatgcgtgagattatttcagctaataaccgtatgttagaacaacaaaaggctgataaggaagcaattgttgaaaaacaaaaggcaaatcaagaggcaatcactactttggcagctaatcgccaaaaattggaagatgacgcccaagtattgcaagtgcgtcaggctgaattggaagctgctaagttaaatttggctgtgcagaaagctactgctgaagatgagaaaaattcattgttggtgcaaaaggcagctgcagaagaagcagctcgtcaagcggcagctcgtcaagcggagtatcaagcacaacaggcagctctagcacagcaacaagtagcctcagtatcagcaccagtcgtgtcaacgctagtagaaactacagtgactgaaacggttgcagcccctactcagacagtatcacaatctacaccaacggtaagcacacctacaacgtctacatcatcaggttcaggtagttcagcggcagcaaataatgcgcgttatgacgcttcatcttacccagttggtgagtgtacttggggagttaaatctcaactttcatgggttggtccttactggggagatgctaaacagtggttagcatcagcacgtgctgaaggttttagtacaggttctactccacaagtaggtgcgattgctgtttggacaggtggttattatgggcacgtagcggttgttacggctgttcaatcttcaacaagcatccaagttgttgaatcaaactacatgggtcgtcgttatattggtaaccatcgtggtggttatttcaatccaacaacgacttctgagggagcggtttactacatttaccctccatattaagaaattttcaaatagagcgtgtggatttgcgctctatttttgtttgaaaaatgaaggaaaaagggttaaaatagtaaaggtagaaatatataggaggctgtcatggcgtttactgacttaaaattgttcgctctttcgtcaaatcagaagttagctgaacaggtgtcgaaaaaaataggaattcctctgggaaaatcaagtgttcgtcaattttcagatggtgagattcaggtaaatattgaggaatccattcgtggaactcatgtgtatattcttcaatccactagctcaccagttaatgataatttaatggaaattttgattatggtcgatgctcttaaacgtgcatctgctgaatcagtaaacgtagtaatgccttattatggttatgcacgccaagaccggaaggctcgtgcacgggaaccaattacatcaaaattggtggctaatatgttgcagacagcgggggtcaatcgtttgttgacaattgatttgcatgctgcgcagattcagggattcttcgatattcctgttgatcatttgatgggtgctccattgattgcggattattttgagcgtcgtggtatggtaggtgatggctatgttgttgtatcccctgaccatggtggtgtgacacgtgcccgtaagttagcacagttcttgaagacaccgattgctattattgataaacgccgtagtgttgataagatgaatacatcagaagtgatgaacattattggcgatattaaggataaaacttgtatcttgattgatgatatgattgatactgcgggtaccatctgtcatgcagcggatgctttggcagatgcaggggcaacagctgtttatgcttcatgtacgcacccagtattgtcagggcctgctatggataacattagtaagtcagcaattaagaaattggttgttcttgatacaattgaaattgcagaagatcgcttaatcgataaaatcgaacatatttcaacggcagaattattagcggaagcgattattcgtattcatgaaaaacgtcctttgtcacctttgtttgaggcaagtcgtgttaaataggtatgagaagagtcaaatgactcttcttttttacatttattttcaaaatgtattataatagttttatatgtttttgaggtggcagaatggatttattgaatcgttttaataagaatttgaatcggattgaggtttcgatgattcgtcagtttgatcagtctatttcggatgttcccgggattttgaaactgaccttgggagagcctgattttacaacgcctgatcatgtaaaagaagcagctaaggctgctattgatgctgatcagagttattatactggaatggctggtcttttggagttgcgtcaggctgcagctgagtttgtggctgaaaaatataatttacactacaatccagaaaatgaaatcctctctacaatcggtgcgacagaagctctgtcagcgagtttagttgctattttggaggctggggatacagttcttctgcctgcccctgcctatcctggttatgagccgattgtcaatatggtgggagcagacatcgttgaaatcgatacgacggcaaatgattttgtattgacacctgagatgttggaagaggcgattattgagcagggtgataagctaaaagctgtcattctcaactatcctgccaatccaacaggtgtgacctactcacgtgagcagattcaggcttttgcggatgtcttgcgtaactatcctgtctttgtcctatcagatgaggtctatgcggagttgacttacactggtcagcctcatacttcgattgcggagtttttgccagaacagaccattttgattcagggattgtccaagtcccatgctatgacaggttggcggattggcttgattatgagtcaggctcccatcatcgctcaaattatcaagagccatcagtatcttgtgactgcagcgtcaactgctatgcagtatggtgcggttgaggccttgaaaaatggtaaggatgacgctcttccgatgcgggcggagtacgtcaagcgtagggattacatcatcgagaagatgacggacttgggctttaaaattatcaagcctgatggagcattttacatctttgcaaaaattcctgcgggttacaatcaagattcctttagcttcttgcaagactttgcgagaaagaaagcggtggcctttattccaggcgcagccttcggtcagtatggagaaggctatgtgcgaatttcctacgcagcaagtatggagaagattcaaacagccatggctcgtttgaaggaatatctagaagaaaatggaacgaattgaaaccaggggattagtcctatataatcggaattttcgagaagatgacaagctggtcaagatttttacagagaaggctggtaagcgaatgtttttcgtgaaacatgcctctaaatccaagctggtagcttctatccagcctttgacctatgcggattttatcgttaaaatcaatgatgatgggctgtcttatatcgaagattttcatcaggtacagccctttaagaatattaacggtgatattttcaagcttagctatgctacctatatcttggccttggccgatgcggccttgcaggacaaggtctatgacccagctctctttgcttttttggtcaagaccttggacttgatggagtcaggtttggactacgaagttctgaccaatatctttgaaattcagctcttgggtcgatttgggatcagtctgaattttcacgagtgtgctttttgtcatcgggttggcttgccttttgcctattcctacaagtacagcggtgtcttgtgtccgcaacactatcaacaagatgagcgacgggcttatctggatccaaatgttccctatctacttgatcaatttcaggctatttcctttgatgagctggaaaccatttccatcaagcctgagatgaagcgaaaattacggttttttattgaccagctgtacgaggaatatgtggggattcacttgaaatccaagaaatttatagatgatttgtcttcttgggggcagattatgaaaccaagaacagaaaatgaggaaacagaatgaaacgtattgcagtagatgctatgggtggggaccacgcccctcaggcagtggtagaaggtgtcaatcaagccttggctgcctttccagacattgaaattcaactttatggtgatgaggctaaaatcaagcagtatttgacagcgacagagcgtgtcagtatcgtccatacgacggagaaaatcaattcagatgatgagcctgtcaaggctattcgtcggaagaaagaggcttctatggtcctagcgaccaaggctgtcaaggatggtcaggcagatgcggtcttgtcagctggaaatacaggtgctcttttggcggcaggcgtctttgtcgtcggtcgcatcaagaacatcgaccgtcctggtcttatgtccactcttcctactatggacggtaagggatttgatatgatggatttgggggcaaatgctgaaaatatagctcatcatctctatcagtatggtattcttggctcattttacgcggagcacgtgcgtggtgtcaaacaacctcgtgtgggacttttgaacaacggtacggaagataccaagggcacgccagttcaccaagaagcctataaactcttggcggaagacaagtcgattaactttattggaaatgtggaggcacgtgagttgctcaacagcgtggcggatgtggtcgtgacggatggtttcacgggaaacgctgtgctaaaaaccattgagggaactgcaaaatccatcgttggtcagttgactggctcaatcaagaatggcggtctgcgtgctaaattgggaggcttgctggtcaaaccaaccttgaaaaaggccttgggggctatggactataaaactgcaggtggtgctgtcttgcttggtctgaaagcacctgtcatcaaggcgcacggctctagcgatgcccagtcgattttctatacgattaagcagacgcgttcgattttggaggctggcattgttgaaaaatcagtggccaaattttcagtagtggaggagagtcatgactagagagcaggtctatcagcgggttgttgaattaattcaggatgaaaagggagaagattttcaagttcaacctgaatctactttggcagataatattgcagcagattcagtagaaatcatggaatttgttcttaatttggaggatgaatttcatgtagatgtcccagatgctgctattgagcattttgaggttctatctgatattgttgattttatttataaagaagtaaaaaaacgttcgtagtttacgggcgtttttctttgttttttcctaaacaaccgtaaatttgttgtgaatgcgaatattgtgtgttagaataaacgaaaagactagaatatttcacgaaaggcgaacattctcatgaaaacagaccttctctattcaggaaaagccaaagacatctacgctacggctgacagcgaccagattgttgcggtttataaggatcaggcgacggcttttaatggtggtaagaaagaacagattgtgggcaagggccggctcaataatctgatttcatctttgatttttgaaaaattgaatgaagctggtgtcccaacgcattttatcaagcgtttgtcggattcggagcagttgaataagaaggtggagattattcctcttgaggttgttttgcgaaatgtgacagctgggtctttctcaaaacgctttggggtggaagaagggataaccttatctactcctatcgtggaattttactataaaaaagatgagttggacgatccttttatcaacgatgaacacattgcctttctagaactggctagtcaggaccaaatcgcctatatcaaggaagaaacaagacgaatcaatgagttcttgaaggacttgtttgctcagattgggctgactttggtggacttcaaactagaatttgggattgactcttctgggcaaattttattggcggatgagttttctcctgataattgtcgtttgtgggatgcggatggcaaccatctcgacaaggatgtttttcgtcgggggctcggggaattgaccgaggtttacgaggtcgtattggcaaaattacaggaagtgaaataaggattggaagatatggcaaagcggatttttgttgagaagaaggcagcatttcagatcaaggcggaggctcttcgtaaggagttgactcataatttgcagttgacaagcctgtcaagtttgcggttagtgcaggtttacgatgtcttcaatcttgaggaggacttgttagagcaggccatcaagcatatctttacagagcaggtgacggacaaggttttgtcggatgaagaattaggtctggaaggtgcagtttattttgctattgaggctttgcctgggcagtttgaccagcgggctgccagcagtcaggaggcccttctcttattgggcagtcgtcaggaggtgcgtgtcaatacaggtcagctctatattttgaacggtgatgtgcaggaagaagaattagttgccatcaagaattatttgcttaatcctgtggattcgcgattcaaggatatggatgctcctttggtggctcaggagttttcggtatcagatactgtcattccaagcttggacttttttgatagctacggggtagaggaatttgcgtcttacaagcgtgaggctggtttggctatggaagtggaagacctgctcttcattcaggattacttcaagtcaattggtcgagtgccaactgagacagaactcaaggtcttggatacttactggagtgaccactgccgccatacgacatttgagacagaacttaggtctattgacttttcagcctcaaaatttcaaaagcaattgcaggcgacatatgacaagtacttggcgatgcggacagaattaggtcggacagataagccacagacgctcatggatatagcgacgatttttggtcgttatgagcgggcaaatggtcgtctggatgacatggaagtgtcagatgaaatcaatgcctgctcggtggaaattgaagtggatgtggatggcgtgaaagagccatggctcctcatgttcaagaatgaaacccataatcaccctacagaaatcgagccttttggcggtgccgcaacctgtatcggtggtgccattcgcgatcctttgtcaggtcgttcttatgtttatcaagccatgcggatttcaggtgcaggcgatattacccaacctctgacagctactcgctcagggaaattgccacagcaaatcatttcaaaaacagcggcacatggttattcttcatacggaaaccaaatcggtttggcgacaacttatgtacgtgaatatttccacccaggatttgtcgcaaaacgtatggagttgggtgccgtagtcggtgcagctccaaaggaaaatgtggtccgtgaaaaaccagttgcaggtgatgtggtcatcttgctaggtggtaaaacaggtcgcgatggtatcggtggagcaacaggatcgtccaaggtgcagacagtcgagtctgtggaaacagctggtgcggaagtccaaaaaggaaatgctattgaagaacgtaaaatccaacgcttattccgcaatggtgccgtgactcgcttgattaaaaaatccaatgactttggtgcaggaggtgtctgcgtagctattggagaactggcagacggtcttgaaattgatttggataaggttccactaaagtatgcaggcttgaacggaacggaaattgccatttctgaatcacaagagcgaatgagcgtggttgtccgtccggaagacgtagatgcctttatcgcagcttgtcgtcaggaaaatatccatgcggttgtcgtagccaaagtgactgaaaaaccaaacctggttatgacttggaatggacaaaccattgtggatttggaacgttccttccttgataccaacggtgtgcgcgtggtggtggatgctaaggtcgttgacagtcctgtcaatctaccagaaacacgtacaacatctgcccaaacactacgagaggacttgaaagaccttctatcagacctcaaccatgctagtcagaaaggtttgcagacgattttcgactcatctgttggtcgttcaaccgtcaaccacccactcggaggtcgtcaccagctgactccgacagaaagttcggtgcaaaagttgcctgtccaacagggtgtgacgacaacggcttcggtcatggctcagggctaccatccttacctagcagactggtcaccttatcacggagcggcttatgcagtcatcgaagcgacagctcgcttggtggcaacaggggctaactggtccaaggctcgcttctcctatcaggagtatttccaacgaatggataagcaggcagagcgttttggtcagccagtagcggctctgctcggttcgattgaggctcagattcagcttggcctgccgtctatcggtggcaaggactccatgtctggtacctttgaggacttgacagttccgccaaccctggttgcctttggtgtgacaacagcagacagctgcaaggttctatcacctgagttcaaggcgactggcgagcacatttattacctaccaggccagattttatcagaagacattgatttcaccttgatcaagtctaattttaaggcttttgaaaaatggcagagcgattatgtgattacggctgctagtgcagtcaagtatggaggagttctagaaagtctagcccttatgtcctttggtaaccaagtcggagcaagagttgagcttgccgactttgaaaccagcttgacaggtcaacttggtggctttgtcttcacatcgcaagaagacattccagatgctgtgaaaatcggtcaaaccactacagactttacactggttgtcaatggtgtcaacctttctggacaggacttgcaagtagcttttgagggcaaactagaagaagtttacccaacagagtttgaacaggcgacggagttgcaggatgttccagcagtcacaagttcagcggttataaaagcaaaagaaaccgttgaagtgcctgtagtttacattccagttttcccaggcaccaactcagaatatgattctgccaaggcctttgaacaggctggtgcaaaagtcaatcttgttccatttgtgaccttggatgcagagagcattgaaaactcggttgacactatggttgacaatattgctaaggcgaatattctattctttgcaggtggattctcggctgcggatgaaccagatgggtctgctaagtttatcgtgactatcttacgaaacgccaaggtccgctctgctattgaccaatttatcgaaaaaagaggcctcatcatcggtatctgtaatggtttccaggcccttgtcaaatcgggcttgttgccgtatggaaactttgaggaggcgggtgataccagtccaaccctcttctacaacgatgccaaccaacacattgctaaaatggtggaaacgcggattgccaatgtcaactcaccgtggttggcaggtgtccaagtcggcgacattcacgctatcccagtttcccacggtgaaggaaaatttgtagtgacggacgaggaatttgctactttgcgtgataatgggcaaatcttcagccaatacgttgactttactggtcagccaagcatggattctaagtacaatccaaatggatccagccatgccattgagggtattaccagtcgcaacggacaaatcatcgggaaaatggggcattcggagcgttacgaggacggtcttttccaaaacattccaggcaagaaagaccaaggactctttgtttcagcggttcgctattttacaggaaaataaatatgacatacgaagttaaatcactcaatgaagaatgtggagttttcggcatttggggacatccgcaggctgctcaggtgacctattttggtctgcatagcttgcagcaccgtggacaagaaggagcagggattttagccaatgatggcggacaattgtgtcgccatcgcggaacaggcctgattgcagaagtcttcaaaaatccagcagatttagaagccttgacaggaacggctgctattggtcatgtccgctatgcaacttctggctctgcttctatcaataatatccagcccttcctatttgattttgcagatatgcaggtgggtttggcacataatgggaatttgaccaacgcggtcagtttgaaggctgaacttgaaaaaaatggttccattttctcttcttcttctgacactgagattctcatgcacttgattcgccgcagtcacaatccagactttatgggaaaaatcaaggaagccctcaatactgttaaaggtggctttgcttacctgatcttgttagaagataaattggttgctgccttggaccctaatggtttccgtccactttcaataggcaaaatgaaaaatggtgcctgggtagttgccagcgaaacttgtgcttttgaagtagtgggggctgactgggtgcgagatgtggagcctggtgaaattgtcgtcattgatgattcaggaattcaatatgatagctatacaagagatacgcaactggctgtttgctctatggagtatgtctattttgctcgcccagattcggtaattcacggggtcaatgtccacacggctcgtaaaaacatgggtcgtcgtttggcacaggagttcaaacatgaagcggatatcgtggttggtgtgccaaactcctccctatctgcggctatgggatttgcagaggaatctggtttgccaaatgaaatggggctgattaaaaaccaatatacccagcggacctttattcaaccaacccaggaattgcgggagcagggtgtgcgcatgaagttgtcagctgtttcaagtgttgtcaaaggcaagcgcgtggtcatgattgacgactctattgttcgcggtacaactagccgccgcattgtccagcttcttcgtgatgcaggtgcaaaagaagtccatgtggctattggcagcccagaactcaagtacccgtgtttctatggtattgatattcagacccgtcgggagctgatttcagccaaccataccgttgaggaagtctgtgagattattggggcagatagtctgacctacctttctcttgaagggatgatagaggccattggtatcgaaaccgatgcgccaaaaggcgggctctgtgtagcctactttgacggagaatttccaacgcctctctatgactatgaggaagaataccttcgtagcctagaagagaaaacgagtttctacattgaaaatgtcaagtaaagacagatgtgtcaacgttacttgacagacctgtaaactgttgaaaggaatcaaaatgacaaataaaaatgcctacgcccaatcgggcgttgacgtcgaagcgggatatgaagttgtcgaacgcatcaagaagcacgtagctcggacagaacgcttgggtgttatgggagccctcggtggttttggcgggatgtttgatctaaccaaactggatgtcaaagagccagtcttggtatctgggacagacggtgtgggcaccaagctcatgctggctatccagtacgacaaacacgacaccattggtcaagattgcgtggctatgtgtgtcaacgacattatcgcagcaggtgcagagccgctttacttccttgactacattgcgactggaaaaaatgagccagccaagctagagcaggtagtagcaggtgtggctgaaggctgtgtccaagctggttgcggattgattggcggtgaaacggctgaaatgcctggtatgtacggcgaggatgactatgacctggctggctttgccgtcggcattgcggagaaatcccagattatcgatggcagtaaggtccaggagggcgacattctcctcggcctagcttccagcggcatccactccaacggctattcccttgtccgacgcgtttttgcagatgtttctggggacgctctgttgccagagctcaatggcagagctcttaaggatgtcctattagagccgacacgtatctatgtccagcaggtgttgcctctggtaaaagcaggtctggtcaacggcattgcccatatcacaggcggtggcttcatcgaaaatgttcctcgtatgtttgctgacaaccttgcagctgaaattgaagaagataagattccagtcctcccaatctttacagcccttgaaacatacggccaaatcaaacacgaagaaatgtttgaaatcttcaatatgggtatcggaatggtcctggctgtcagtccagggaaggtggagaaagtccgtgaattggtaggcgaagaagtctatgaaatcggccgcattatcactaaggaagacaagagtgtggtcatcaaatgaaacgaatagcagtgtttgcatcaggcaacggctccaatttccaagtcatcgcagaacagtttgaagtagcttttgtcttttcagaccgcagaaatgcctatgtcttggaacgagctgaaaaactaggtgtaccaacctttgcttttgaactaaaagagtttgcggataagcaggcctacgaagaagccattatccaactattagaccagcaccagattgacttggtggtcttggcaggttatatgaagattgtgggaccaaccctgttggctcaatatgaaggtcgtatcatcaatatccacccggcttatttgcctgaatttccaggagcccatgggattgaagacgcttggaatgcaggtgtggcagaaagtggtgtgacagttcactgggttgacagcggtattgacacaggacaaattatcaaacaagtccgagtgcccaggctggctgatgatatcctagaaacctttgaagctagaatacatgaagcagagtaccaactctatccagcagttttggaggagttaggggcagtgaaaaaataaggagaaatcatgacaaaacgcgcactaattagcgtatcagataaaaatggtattgtagaatttgcccaagaattgaccaagcttggctgggaaatcatttcgacaggaggcacaaaggttgctcttgataatgctggtgtagcgactatcgctattgacgatgtgactggttttcctgagatgatggacggccgtgttaagaccctgcaccccaatatccacgggggtttgctggctcgtcgggatgtggatagccacttgcaagcagccaaggaccatgaaattggcctgattgacttggtagtggtcaacctttatcctttcaaagagaccatcttgcgtccggacgtgacctacgacttggcggtggagaacatcgacattggcggtccgtccatgttgcgttctgcggctaaaaaccatgccagcgtgaccgttgtggtagatccggcagattatccgacggttttaggggaaatagcagagcagggtcagacgacctacccaacgcgtcagcgattggctgccaaggttttccgtcataccgcagcctacgatgctcttattgcagactactttaccaagcaagtaggcgaagacaagcctgaaaaattaaccattacttatgacctcaatcagcctatgcgttacggtgaaaatccgcagcaaaatgcggatttctaccaaaatgccctgccaacagactattctattgcagcagctaaacagttaaatggtaaggaattgtccttcaacaacattcgtgatgcggatgcggctatccgtattatccgtgatttcaaggaccgtccaactgttgtggcactcaaacatatgaacccttgtggtatcgggcaggcagaaactatcgagaaggcttgggattatgcttatgaggctgacccagtatcgattttcggaggcattgtcgtgctgaacagagaagtggatgctgcgacggctgaaaagatgcacccaattttcttagaaatcatcatcgcaccgagctactcggcagaagcgttagctattttgaccaataaaaagaaaaatcttcggattttagaattggcttttgacgcacaggatgcaagcgaagtggaaaaagagttcacaggtgttgtaggtgggctcttggtgcaggatcaggacgtggtggtggaaagcccagcggactggcaggtggttaccgagcgtcaaccgtccgagcaagagtgggcggccatggagttcgcctggaagtcttccaagtatgtcaagtccaacggcatcatcatcaccaatgacaagatgaccttgggcgtgggaccagggcaaaccaaccgtgtagcgtccgtccgtatcgctatcgaacaagccaaggatcgtttagagggagccgttttggcgtcggatgccttcttcccatttgctgataacgtggaagaaattgctgccgcaggtatcaaggctatcatccagccaggtggctctgttcgcgaccaagactccattgacatggctaacaagtacggcttgaccatggtctttacaggagtcagacattttagacattgagagttttggatttagctcacttcgtgtgagcttttttattcccgaacattaccctgctttttctatcaaaacccgtctatttttgctatactatttatagaaaatccgtttttgaggtgtaaaaaatgaaacttttggttgtcgggtctggtggtcgtgaacatgctatcgcaaagaaattgttagagtctgagcaggtagagcaggtctttgttgctcctggaaatgacggaatgactttagatggtatcgagttagtcaatatcgggatctccgaacattctgctataatcaactttgctaaggaaaatgacgttgcttggacttttgtgggtccagacgatgctctggcagcaggaatcgttgatgattttgaacaggcgggacttaaagcttttggccctagtcgtctagccgcggagctagagtggtcaaaagactttgccaaacaaatcatggtcaaatacggcattccaacagcagcctttggcacattttccaacttcgaagaagccaaagcctacatcgaagagcagggtgcaccaatcgtggtcaaggcggacggcttggcactgggcaagggcgtggtcgtggcggaaaccgtcgagcaggcggtcgaagcggcacgggagatgctcttggacaacaagttcggcgactcgggtgcccgcgtggtcatcgaggagttcttggcgggtgaggagttttccctctttgctctggtcaatggcgaccaattttacattctgccgacagcccaggaccacaagcgtgcctttgacggcgaccaaggtcccaacacaggtggtatgggggcttacgctcctgttccccacctgcctcaaagcgtggtggacacagcggttgacaccattgtcaagccgattcttgagggcatgattgcggacggccggtcttatctgggcgtgctctatgctggcttgattctgaccgaccaaggtcccaaggtcatcgagttcaacgcccgttttggcgacccagaaacccagattatcctgcctcgcctgacctctgactttgctcagaacatcgacgacatcctccacaaacgcccgacacagctgacttggctggatagtggcgtgacgctgggtgttgtcgtggcatcaaacggctaccctctggactacgaaaaaggcgtagagttgccagcaaagaccgagggcgacatcacgacctactatgcaggggctcgttttgcggaaaatagcagagcactgctttcaaacggcggtcgggtttatatgctagtcaccacagcagacaccgtccaagacgcccaagaaaaaatttactcggagctgaaaaatcaagataccacaggcctcttttatcggacagatattggaagtaaggcagtaaaataagggataaagaaaaggaaagacaagcatgaacattccaatttccatcatcatgggttctagttccgactggaaaaccatgaaaaaagcagccgatatgctggacaaatttggcgtagcctatgaaaagaaagtggtctctgcccaccgcaccccagacctcatgttccgtcacgccgaagaagcgcgtggtcatggcttcaaggtcattatcgcaggagcgggcggtgcggctcatttgccaggtatggtagcagccaagacaaccctacctgtcatcggtgttcctgtccaatcccgtgccctcagcggtgtggattcgctctattctattgtgcagatgccgggcggcgtgcctgttgcgactatggcgatcggcgaagcaggtgccaccaacgcagccctgacagctcttcgcattctctccattgaagatcaaaccattgcggctcagctggcagattttgccaaggaacaggaaaaaattgcggaggcgatgacagatgacctcatctaagacaatcggaattatcggcggcggtcagctgggtcagatgatggctatttccgctatttacatgggccacaaggtgatcacgctggatcctgcggcggactgcccagcctccaaggtcagcgaggtcatcgtcgctccctatcacgatgtggcggccctcaaacagctggcggagcggtgcgatgtcctgacctatgagtttgaaaatgttgatgccgacggactggacgcggtcatcaaggacggccagctccctcaagggactgacctcctccgtatttcccaaaaccgcatttttgagaaggattttttggcaaaaaaagctggcgtgcaagtcgccccctacaaagtcgtcacatctagcctagacctagaaggactggacctcagcaaaaactatgtcttaaagacagccactgggggctatgacggacatggccagaaggtcattcgagaagaggcggacttggtagaagctagtcagttagctaactctgccgagtgtgttttggaagagtttgtgaatttcgacctggaaatctccgtccttgtatctggcaatggctccgactacaccgtctttcctgtgcaggaaaatatccaccgcaataatatcctttacaaaaccatcgtgcctgcccgtatttttgacgaacttgctgaaaaagccaaaaccatggccctgcaaatcgccgacaagctccatttagtaggcaccctctgtgttgaaatgtttgtggcagggcaagaaattcttgtgaatgaaatcgctcctcgcccgcacaattcaggacattattcgattgaagcctgtgatttttcacagtttgacacccatatacgaggcattttaggggagcccctgccccctatccgcctgctttcaccagcagttatgattaacgttttgggacaagacatggaaacagtccaaacctttcttcaagaaaaccctaccgcccatccccacttttatggtaaactagaagcgaagcacaatcgcaaaatgggacacgtgacggtgttgggggaagatgcggaaagtgtggaggagtttgaaaattaagattgctttctgattttttagttattaaaaagaggtttatgacatgccattaccacaaaaaattcaagaagagattaaaagatattgcaataatcacttgcctaataatgactggtatgagaaagagtttgattttatacatgatgtgagtctgaagaatagaattattagagagtttaaatcaattcggtacgcttacaagttatacgaagggataacggctgaggaggaacatttaatttttgaaattcgcagtcaaattttagcatatgcctctatatatgaagcagtagtagagtacgttttagagacatactatagtgatactcaagtttatgatgatttggtccatcaaaataatgtgatgacaaaaattgacataccagaagaaaagaggaaaaaattagaaagagaattaatccatctagtagataatggtacaaaaaatatagaaatacatacatttttttatcaaagaaagaggaaggcatcaacttcaattcgttttgatgcaaagtgtcgtgcagcagaggaattaaatataatttcaaaaatttatcaaaaaggaaataaagttgttgcagatttaccatccgatattattgaaatttatgagtacaggaatgcaatccatttgatagccgagcaacgtaaaaacattgactatgaattagaacttagtcaacgagcgtatagaagaatgaaaccttttatagaacaaataaaagataggctaattacagataataaattaataataaaaaacaccaaggataccttgactgacagctctattaaaaattgaaagactaactcaatatgatagggagaagatattaattcagttgaataaataaaaattttagggagatatagggtgttaaataaagagtggtatttcaaaaattttaatatggtttcagagttggatatctcaggagaatttatatatactggtatttccattgtaaataatatggatagaattgctccagagatgcctacggaattatttttggctttatacaacatttctgtaggagtcgaaagactacagaaaataatattagtgttgtgggagttcgatgaggttgattccatagaagacttttctgaaagtctaaagattcataatcaagttgaattacatagcagaattgaaaaagcgatcaataaaaagatttttagtaaacaagaatgccaatttttagaacttttaaaagagttttattctaatgcgaggtatgatagattttcagcagtggggaatagatgggaatatgaacttattagtaaatttttctctaataatcaaatcagttatgaagaatcagtttctgattctcaagtaattttaatcaacgatagtattaggaaattgatagggcgagtgctctctagaatagtaaaaaactactacctacttgtggaggaaggaagtaataaatcaggaacttattcatatgaactcagaaatgattcaaaagctcagaagatatttttacatatggagaatcgccgaggattaagttccataaaaatagatgaacggatagctttaagtgaaattcttatttatttgagaaatacatctgataaatcgtcatatttaaaatttattgagggaatatatcctcttgattttgataaaatggaaattagtagatatttatcaataattttactagaggatagaatccctcaagacttaattgatgaaattgaatatatttacgcagaaaaagatattaaggtaggagagcgaatagaaaacttagatttattaacaaaaaataatatgcaggttacattcgattatccttatttgaaggaagtatatataattttagaagaagtcaaaaaacaggaaagtattaacgatgatacaataagtaggttagaggagtctaactgttatattgacgatagtgatactcaagaaattatagaatctatcattgctgttgctcgccaatatcgcaataataaaattttgaaggaagagtttattaaagaatttagcagtcactacaaaactttagaagataattatacattaagttatattagtaacttgatgcaactagaagtaaggagcaaataaaatgattgaacgttattcccgcccagagatggcggctatttggagtgaagagaacaagtacgaggcttggttggaggtggaaatcctcgctgatgaggcttgggctgagttgggtgagattcccaaggaagatgtggccttgattcgtgagaaggcgacttttgacatcgaccgtattttagagattgaagaggaaactcgtcacgatgtggtggctttcacgcgtgcggtttcggaaagtcttggtgaggaacgtaagtgggtccactatggtctgacttcgaccgacgtggtggatacggcttacggctacctatacaagcaggccaacgacatcatccgtcgtgaccttgaaaactttaccactatcatcgccgacaaggctcgtgagcacaagtacacgattatgatgggccggacccacggtgtccatgcggagccaacgaccttcggtcttaaattagcaacttggtatagcgaaatgaaacgcaacatggagcgttttgatgtggcggccaagggcgttgaggctggtaaaatttcaggtgcggttggaaactttgccaatattcctccatttgtggaagaatatgtttgtggcaaattgggtattcgtccgcaggaaatttcgacccaggttcttcctcgtgaccttcacgcagaatatttctcagccctagccttgattgcaacgtctatcgagcgtatggcgacagagatccgtgggctacaaaaatctgaacaacgtgaagtcgaagagtatttcgccaaaggccaaaagggtagctctgctatgccccataaacgcaaccctatcggctctgaaaatatgaccggtctggctcgtgtggtgcgtggtcacttggtgacggcttttgagaatgtggctctctggcacgaacgcgatatttcccactcgtcagcggagcggattatcacgccggatacgaccattctcatcaactatatgctcaaccgttttggcaatatcgttaagaacttgacggtcttccctgaaaatatgaaacgcaatatggagtcaacctttggcttgatttacagtcagcgtgtcatgctcagcttgattgagaaaggcatgacacgtgaggaagcctatgatttggtgcaaccaaaaacggcgcaatcatgggacaatcaagtggacttcaagccccttctcgaagcggatgagcgtgtgactgccaaactcagtcaggaagaaatcgatgaactcttcaaccccgactactatgctaagcgggtggatgacatctttgaacgacttggattataaaaaaatcaaaattctttggattttccagagaatttttttgtttacttgcgaataaataggtgaaggggaaaacaagctccctccgctagacaatcattcgtaagaggatgagcagaaagtccagcctagcttctcagagttcgtatcaacatttcagcgcagtggttgattggcagattcgttcgcgtttcacgctccaaatctgacctaatcaactgtgcggggtgggaagacgaactctttagattggtcgagttctgtcccactcccaaaattttacgaatagataagtgtaggggaagcaagctcacaacttattcaaaaaaataagattttttcaaaaaaaagaaaacgatttgcgaataagtatagtgagagggaaaatccccctcaaggagatacacacttgaaaaaaataaatcattttcaaaatgatttacgaataaacaagtgtaggaaaaatgaaaggagaagaaggatgaaaaagaagttcaagattgtaaacaaacgtacaacgattgacctcgggattattaagtatagctaccgtcgtggtcgtcataccttgtaaatcaatcagtaaatcaaattgttaaagtaataggaggaaatagaaatgaacaaattttttaagaaaaataaacgtgtgacaatcgatctaggtattatcaaatacacctatcgtcgtggtcgtcatactttgtaaacagattagtaaatcatattatttgtaaatttttaaagaaaaaggagtaaaaatgaaacaattatttaagaagaataagcgcatcactattgatttaggtatcatcaaatacacttatcgccgcggtcgtcacactttgtaaaaagaacttgatagctaatttgatttagctatcaataagatgggaatttgttacagttcctatcttattgataaaaaggggaaacaatatgaatatgtttaggttaatttttaagtcggtgatacatcgaagggatgttgctttgttctatgcttttgcgggtttgccaatcttagttcctatattgtccaaatttttggtaggcgtaaaggctgaatatacggataattttttagattttctaggagcagcattggcaacacaggacgggatagtgttacctgtattactgttatccttgattatttcagcagtctttagggacgagattgatagtggcattctatttttatataaagatctgaatagaacccgactttttaatgcaaaaatcattagtttagtggtgatgtatgcctcttatgtccttctaacagtgctgacaagtgcgattgcttattttggcttcttgaatgcttctggaaaagtagtatcggatgattggagtaatgtacagtccactttcctatctatttttgcaacaatttcaatcaatgttatcggtattttattggtttctacggtttctatcaaagccaaatccttacaggcagttttagcaggagttttttggtcactgtttacaacaactgcaccacttctcattggagttcgttatgttgtgccgaatggctatgctaagatgagtcttgatcagccactgcttgcatggtccttggtagtagctataacgacattttatactgttgctacctatctcaaaggtcgttcgaactttgaaaagctagaattttagaggtgttttatggtagtgcgctatatgaggccagttgctttatcgcttgctttgattgttttagcctccattagttatcttttggcaacatctttggttttgtttagctctagtcaatttctacagctagcctacctattttctattatggttggaatgccaatagggtttattctacttccatctatgataaccaagcgttatcagctttgtcaggagctatcggaagtgaagttcagttggaaaagctttgttttgctggctattgcaattttcttggtcaatttctggtttattcagagtgatgagtatgtgaatcaatttattattgcgacttgtgaagaattcttgttccgttatcttatctatcgtattctaaaaagtgaatatcctacttggctagctatgttggtcacttctctcttgtttggagttttgttgcatatgaattattccttgctggataatctaatcatccgaactccactaggtttattgttttctgtgttagctactcgttttggcttgcagtatgctatcggaggacattggatctacaatctgttggtttcgagatttccattttaattgtgagggtcatgatgatatttattctattattgagtctattttatatttgtttaacagttgctagttcgcaactattgctaagtctctctgttcctgttttattgttgttgacttatttgctaccgcccatcgtcaattcaatctgtatgggattacaaaaagataagtcttggaaagcgtggtcagcaggcattttcccaacaatgtcaatgatattttatgccgcttttgcctacattacgagtagcaatggtcagtgggagcagtttgctcaactgcatacagtttcagatgatgtcatgagtgtcgagctggcaggagaattgttagttccatcacaaatgctatttgttgccgtactatattatggtacagctattgccacttattttattcagcaggcaggtcgtaagaaagaaaaaggagctacttatgcttaaaatcaatcatttatcaaaacagtttgcaggaaatgaattttactcactaaaagatgtgagtttggagatcaataagggcgagattgttggtctgattggaaaaaacggtgctggaaaatccacgcttatgaaactcatggccaagtccctaaaaccaagttcgggaaccattacttataagggtacggatatttttagccaggataatttgttagcagactttgggattatgattgatccagtattctatccagaaatgactgttatggacaatctcaagttttatttggacctgcatgggaaaaaagacctctatccaaatattgagaagactttgaaattggtagagttatgggatgctcgcaatcggaaacccaagggattctcgttcggtatgaaacaacggacagctttggcgattgccttggttgcggagccagatttcctgatcttagatgagccttttgtgggcttggacccgattggtgttcaaaaattgattgatatcttgaagcagtggtccagtgagcgacaaatttccatgctgatttcgagtcaccaactaggtgagctggaggccttgtgcagccgctatgtctatatcgaatcgggagaattggcagatgcttttgaaggcaaatctcatccaagtgtgctcgtgcagttggacacgactaaaaacttagattctgtgaaggacttgctcaatgaccatgtggtgctagagggggaagtgttagagatttccactgccacacctacaagtgagctaaatcagatttttggtgtgttgactcgtcaagaattgattgtgaaactagaagtgaaagagaatcacttgaaagaaatctttacgaaagggtagtgagtatgaagcaaatttttccagctgtctttagaacgatttggaagcgaaaggagacgcaggtttatctcctattcactttgtttccttttatttatctagttacttcgtttattgaagggtcgaattttatgcagattcatgctggtgagggctataaagtcagccttgttgcctttacgaatatgatggtgagctcagcagatagtttcattcttcctagtttgaccctgtatttcttggctatatctgtctttaggaaagaagtagatgaacataccatgtttttataccgggatcttggacggaagcagattttctggtctaaatatttgggtctcttagcaacaatcgtcattttctatggtctcttctttgtaacctctgcatttgtacattatgttcgggtaatccatctaccttttggtagtccagctgtttttgaagctagtttggcagagagcttgagtaatgtattttgtattgtcgcttatttgctaaaagatattttatcgattagtttggcaactgctctttgtttgtatctgaaaaatattaccacaatgatcacaggatttttggtgacgattacgatgatgattttagcaattgttggcggtccagttgcgatgctttttccaactagttatatgactttggcgagcgaaggcctgacaggagcggggcttgcttatttaggagctatctgtgtcacaattatttacgtactcgtatttactaaaattgctgcgaaaaaattcaagaatttggagttctagttatgaataaaagactcgtcggagtgttgttgaagtcgctcaataaaacgatgttcttgtttgggatagttctgagtgcacttggggttggaatggggttgttcctgccccagtttattggtaaattgctagatcaaacctatttgagcaatctattaacacggccagaattgctggcaggtttcatccttttctttgtatcggtctatgcagtacaggctctatctaattatttcatagggcgtagtggtagtaatgcactcaaacagttgcaacaatatatttatgaatccttgttgaccacatctgtaaaggacttggatcagtaccaatcaggtgatcttgctagtcgtttgactaatgatatgtcggttgttctgaacttcatcaccgttattcttccaaatttcttgatgaatggtttgatggttatggggtcaatttattttctgtggaccatcagtccgtggctcacgggtcttagtctcttcttgcttcctttgttgtcaatggttatgattccgatgaatcagcggttggaaggttactactctgcttaccaagagggattagggcaggtttctagtagaattagtcataaatttacaacgattcgtttgatgaaggcttttcagggagaaaagcatgaacagcgagagatgggcaagtcttttcagtatctgtcacaaacctttgagaaaatgattggactgtcagcggtgcaacataccttggttagtagcttaatgacgggatttattatcctgatgttgcttatagcggggatagaagtaaccaagggagtgatgaccatggctacattgacaacctttgtattgtacatgatgcaactgattgatccagtcacagacattgctgcttccctaaatgaactgacggagtttcatgcagtgtctaaacgtttggtagaattgctggaactgaataaggaagaacaggtagatacagagttggttgatgctactagtatccagttggaaaaagttcggttttcctatcatacagatccgattttgaatggagtatcggttagaattcctgagggagctcacgtggcgattgttgggccaagcggagccggaaagtcaacgatttttgccttgctgatgaaatattatcaagactataaggggaagattcggattggtcaacaatgtttaagtgatatttcaaccaaggagatgagaagattgatttccttcatacctcaggacaatactctctttcatgggacgattagagaaaatctattgtatggaaagaacgagtctgtgtctgaagagcgtattgcttatattctcaaggagttgggattgtctcctttagtagctgagttggaagatggtttagatactcggatttcagaaaatgggacaggcttgtcggaaggccaaaaacaacggttcagcattgcaagagccttactgctagaacatccgatttatttgctagatgaggcgacagcaagtttagatactgtcacagaacgtgtcattagcaaagcgattgaccgattaacagctggcaaaacaaggctaaccattgctcaccgtttgcatacggtgcgtgaggcagatgctattttggttttagataaaaatggacaagtagctgactacggtcatcaccagcagttagtggagagaaatcatctgtatcaagatttcttaagaggcttaccgcaagccagttagtgaatgggagtcaatggaccgaccagtctaagtctagggttacctaataataaaatggaatactgatgattacttgtacaatgaatagataggagaagagaatgaaacaaacaacatataccttatctttgggaggaagtgacagagagaactccagagtttcgaagatggaagaaaagtttgaaaaatatatggagggaatcgcagagcggttacagcaatctgggaagaagcgaattgacaaatggtttgttcatgtgcgaattgaggagtaaagtagctatgaccaaaattcacagacgtttttataaatagtgaaaaatagaatgaattctcttttagtttcccttaagtttggcgagttatactttattcaagctagaaatagcgagacttttactgaaatagtttcaatatcgtcatccgtaagagctaaagctcaaacggctggcatatcttttcaatccttatctctaagtcgcaagcgacaaggactagggattatataatctcctgagaatactggactcactgagtctggtattttcattttatgctataatggtttcatgacaaatcgaattttagatatggaacaaatgcaggacgaggaatatgtcgagcgtaccctgcgtccgcagaaattaaacgaatacatcggtcaggacaaggttaaggaccagctcaaaatctttatcgaggcagccaagctccgtgatgaagccttggaccatacccttctgtttggacctccaggtttggggaagaccaccatggcctttgtcatcgccaacgaactgggcgttaatatcaagcagactagtggtcctgttattgaaaaagcaggtgacttggtggcccttctcaacgacttggagcctggcgacgtcctctttatcgatgaaatccaccgtatgcccatggcggtcgaggagattctctactcagccatggaagacttctacatcgacatcatgattggggctggggaggccagtcgctccgtgcatttggagttgccgccttttaccctgattggagcgaccactcgtgcgggtatgctgtccaatcccctgcgggcccgatttgggattaccggtcacatggagtattacgaactggctgatttgacggagattgtcgagcggacggcggatatctttgacatggagattactcatgaagctgctattgagctggctcgtcggtctcgtggaactccccgtatcgccaaccgtctgctcaagcgggtgcgggatttcgcacagattatgggcgacggcctgattgacgatagcattacggataaggccctgactatgctggatgtggaccgagaggggctggactatgtggaccagaagattctccgcaccatgattgagatgtacggtggcggtcccgtcggcctcaacaccctgtcggtcaatattgccgaggagcgtgagacggtggaggacatgtacgaaccttacctgattcagcagggcttcctcatgcggacgcggacagggcgggttgcgacagccaaggcttacgagcacttgggttatccctatacggaaaaataatggcagagcagatgagacaagcagctcgtttatttggagactggcctgagacgattatctggacctgtttagaaggtgtcatgggagacatttatgttgatgacagccagttgccccagtcagccctagcactctacggacggcagagcttctttggttttttagctggccagccacatcgagacttgctaaaaatctgcgaaggtaaggatatgattctagtccctcaaaaccaaaactggtctgacttgatagaagggacttacggagacgggattcggtcctttacccgctatgctacgaaaaaggacactgagtttgaccttgggcatttacagaaactggttgatgacttgcctgaaagctttgatatgaaacggattgaccgtaatctgtacgaggcttgtctggtagaggaatggtcacgggatttggtgggaaattatatagatgtggaacaatttttggacttggggctgggctatgtcatcttgcacaaggggcaggtggtctcaggggcttcgtcctatgccagctattcagctgggattgagatagaagtggataccagggaagactatcgaggtctgggtttggcaaaagcctgtgcggctcagttaattttagcttgtttagaccgcggtctctatcctagctgggatgcccacaccttgacatccttgaaactggctgaaaagctgggctaccaattggacaagccctatcaagcatacgaatggagataagatgacaccgacatttatttgggatttggacggaacgctgttggattcctatgaagcgattttggcagggattcaagaaacctatcaagaatatgttcttccctttgaccgtgcagaagtaagaaagtttatccttcgctattctgtcaaggatttgctggtgcgtgatgcggacaagtacggtctggatagcgatgagctcaatcgtgtgcgtgcgacttccttgaaggaaaagaatacgcagattcccttgatggctggtgcggtggaaatcttaaactggactgcggaacaaggtattcaaaactttgtctatacccacaagagtgacaatgcttttcaggtcttggaggatttgggtgtccgtcaccatttcacagaaatcttgaccagcgattctggttttgcccgcaaaccaagtccagaagctctgctatttctcatcgaaaaatacggactggacaaggaaaatacctactatatcggtgaccgtttgctcgatgtagaaacagctgtcaacgcaggaattcacagtatcaacctgcaaattgatggtgtggagcagaattggaagattgtttctttattggacataaaacaaatattaacagataaatcaagtcataacaacctgtgaaaacgggtggcttgtacaccagctataagctgtttctctccagcgacgtctaaagatgtccgctgaacttcgttcaggttagtgctatgattacttgactaatgcccgtaacatcgggcttttgttttgttatggcttcaagctataataaaaatgagtccaaccgtctgttttaagaagagcatgatatggaatttgtgtaatatatttgatataatttaaaaagtatatttggaggtgtggtttatgaacgataaggaatttggacagcgtgtacgtcaattacgagaatctgctagtatgacacgtgaacagttttgtgacgatgaactggaactctctgtgcgccaattaactcgtattgaagcaggtgcttccaagccgactttttcaaagattcagtatattgcaactcgtttaggtatgggactgggactttacgagcttatgccagattatgtatctttacccgaaagatattccaagctgaagtttgatgtgcttcgcaccccaacttatggtaatgaagatttggcggaaaagcgagatgccatgatgacagaaatctatgacgattattatgatgaattgcctgaggaggagaagatagcaatagatgcgattcaatcacgaattgatactttagagtcaggtacagcaggctttggaaaagagatactggaagactactttgaacaaatttttcgcaaacgaaagtatgaattgaatgatttgttgattgttaggctccatcttgaatatgttaggttatctagctgtgattcagaaatatttagacagtttttgaaaattatagagcatttacatgagcaaatcaatatcatcaactcaaatgatttatttgttttacgagacacgctattatcttgtgtaaatatattaggaagtaaaaaatattacgaaccaataccaaagatatttgacagtgtagataagattatacagtcgacacaagattttcagaaaaagcccattgttagtgtattaaaatggaaatatgcactttttgtggataaggatcgggatgaggcagaaaagcattatctagatgcggtgctatttgcaaaattgatagaaaatagagagttagaacagaagattgaagaagattggagagttgacaatcaataaagtgacatttttgtcctgttgaagaattgtgaaatgcattatactaaactcataaagattaaaggagattagtaacatgtttaactatttgaaattttttggtcgtcttggcggtaactggggaacatgggttgaagaataatattattaaaaagggagcgggaaagacatccatgatggctccgccctcacccacagaataatgaaaacgaacataaagccctcactaggtgtataatcttagtgagggctttgtggttaacgagttaatgatgttagtcatcgcgggaaaaactaactcactctactgacgagcaccccaaaatatgcgacaggcatgagtataaaaatacgactaaaattcggtagataagctctctaatttttagaaggagggaattatcatggatgttctctatcaatcttgtgcaggtattgatgtccatcaagccaatattgttgtctgtatcctacatggaccactcacctcaactcgtccaaagcgtgagatggctacatttgatacaacgactaaaggcctacgtgcttgccacgattttctcagtcaatttcatgtggaagctgttggtatggaaagcaccggtgtctattggcgacctgtctggcatgctctctgtgatgacttcgagctgatactcgctcaaccagcccacatgaaggctattccaggtcagaaaaccgacaagaaggacgctcactggattgccaaattaacacggattggtctgcttcctcggagtttcgttcccgatgaaaccattcaagaattgagggagttgaccagacaacgaaaacattatgtggaaagtcgcaatcgagaaacaaaccgtatccataaatttcttcagtcaggtggtatcaagctaacaacctatattgaagatattatggggctatctggtcgcaatctccttcagctactggttgatgggacgcctattacacctcgcattgttcatcaatccgtttataccagcttgaagaagaaagtgccgcagcttctggaagccttggacggttatttctctgaccatcatcgctttatgttaaagcagtccttagagatttatgatttttatcagaagcagattgagttgttggaagagcgaattactgtctatctatcacaatatgaaaaccatgtagaaacattggattccatcccaggcattgatgtcattacagcttctgttatcatttctgaggttggtgttgacatgagtcagtttccgacatctggacatttagcttcttgggctggactctgtccaggtaataatgagagtgctggtaaaaaacgaagtaccaagattcgacacggaaattcatatttgaagaaatgtttatgtcaagccgctttcgccgctaggaaccagaaaggaagtaccctagcagaccgattttatcagattcaaagtcggcgtggctcacaaaaagcaaccattgcacttgcgcatcaactattaaaaatagcctatatccttttaaaagaacagatgacttatcctgaatttttagcacaaaaaagactactagggacgagctagtagcctaatataaaaattgtttcactttgattctatcatagggagggagtttctgcattcttttgagttttcgtataagaactcgactggtcaaaaagagttcgtcaacaagtctttatttctagttgttgagctgaaacagtctattcccagacatcaatttatgtgagctgactgccgtcagcttatatctcccactttaaaaggtctcccagaccttttaaactcccacccccgtatagctccaacagtcagagtagtgactgttggaggttggagataaggcgaactctgttcgcatcagtcgtaatggtcagatttggagtgtaaaacacgaacaaatctaccaatcaaccactgcgctgagatgttgacacgaattctgagaagtgtgctggcttgagcccaatgtcattaagttaagcatttaaacaattaaagaaactattcccgtctgagcagttgatgacaagacgggaatagtttttgtatttagggcacacaaaaaggaaggtttttaacccaattttttaactattatgatattctataagtgaagcttacgggagcctggctttttatctttctttggaaggttcgattgggtcggatgatggataaatgtttggcaatgtaggtttctaattggaaggaagtaagttcttctctaagaaattttcgacaggcataaacagcgtctgaaaaacaaattttataagtctgttttaactttgatgttttaatggtaacgtgtgaggttagccatttacaaacattaaagttgataaagcgagcgtagatttcttgcagaatcccttccttctttttcgcatgaaaatgagtcaacccaatactgtattttaggtcacgaaaactggtctctatgccccatctgtaggcatagagatcttttaatttttctggtgaataatccgtatttgtcaccaaagtctcaaagaaacctggcttgatttcgagacgcaccatccgaaaatgaaggtcataaaactggagtggatccctttttcggctagagtttggtaaaaagtcaaaggatgtgtgattaggtaaacagcgatagtgattaggaaagtctcgatacagttgtttcatctcattggtttgttttcgacagatgtttaggtcaaatgcctcatcaaaacaaggggtgtcagggaggttaaatcctgacttcatagaatgattcccgacacgaatacgaataatataggaccaatttctttcttgacagtgtaccatgacattgtaggattcataccccctatccattatcaccagagcttgtttgaaagaagaggtcttcagcatgtcaataaaagctgctcgttcatcaagattcctagttagctgacttttccgactaaaatcttttttaggatgaagtaaaaactggtttgcggtggaaacgatgtcgttaatactatcaagtaaatgagctttaatctgatctagcatgacttttccccttttatttttagtgtactatagaaaaaactaacctaccacaaaacgtgataggttagttaacttaatgacattgggctttttgcccagcctcttttttgttatactagacagtatgtaggaggtggctatgttagaaaattggttaaacaccaaacaaggtcaggtgtttcattacaagatggaaaagattgagtatgccctagaactgctagggaatccccagtttgcagttccggtcattcatgtcgctggaactaatggcaagggatcgaccattgcctttatgcgcaagctatttcaggcacatggtatgcgtgttggaagttttgtatccccccacatggtgagtgtacacgacaggatttgtattgacagccagcccatttcagaccatgattttcagcactatttacagaaagtctacgatttggagcaggaaatcgccactcgttatgagccttttcgctattttgaggtcatggtgctcattatgttcctctatttcgaagctcaacaacccgatgtggcactagtagaggtgggcatcggaggacttttggatacgaccaatgtcgtggccccagccctaagcgttatcacctccatcggcatggaccatcaggatttattaggctcgactttaagggaaatagcagagcagaaagcagggattatcaaggaaagcgtacctgtcgtcctaggaccgctttctccagaaaccacagccatctgtcgccaaattgcccaagacaatcaagcacctgtctaccaatttggtcaggaattcacctataaagcaggacagttcagcaatccggacatcgacctgtcagaattggttttgggtctggctggccatcaccaagaagagaatgcggccgtagccctacaaacttttctactctatatgaccaatattcaaaaagacattcaacctcagttgattcaacaagcccttgcccaaaccagctggcctggtcgtttggaattggtagttcaagagccaaaaatctatttggatggagcccacaatgtccccgctatcgaacgtttgcttgaatttattcaggttcaagaagagcctgtcaccattctcttttcggcccttcggcgcaaggactttcaagaaatgcttgaattattagaagaaaaattgccacatactccacttgtattaaccagctttgcctatgatggtgccttggctgaggaaaaccgacaaggacgagattatgttgagaattatcagcaatttatagaagactggcaatctagcaagcaagggattttgattgttacaggctctctctactttatctcagaagttcgtcggatttttaaaaaatgaatatctttttgcgaataaataggtatgacacatgcagaaaaagtagcctttttaaaagaatttcaagagaacaaacgccatacttttcgccaattagaacagtttgcaaaaatttccagaactcccgataggaaatgacatcgggagtgctttttgatataataaggaaagcaaatccaaggagaagaaaatgacagaattagatgtagtttcggacgtagttactcatcctgaggaaacttatcggcgtagtcgtagagcatcacgtagacagcaagtgcaactgaatggtgaatttcatgaaagagtattaaagacaaagtattggccagctcttgtttggagcttagttttaagtgtttttagcgtagccaatccactgctaatgccatttgcaaccaatatacaaactcaaaatttatatgcagggatggcaatggcaaatggacaaatcccttatggtgatttctttggtacaagcgggttattattctacttacttgctttcttaggtcatctgggaggaactttcattatctttggaatcctccagtttatagcattactgatagcgggagtctatttctataagattgtagcttattttagtcagtcagaacacctagcgataagttctagtcattggttctatgtatttatttttgcacttggttttggagggatgtatgcagaaatgtttgctcttccgtttcttttgactagtgtgtggtttctggtccgctattttgaaaatgcagtgcgtgatgaggcatttatcctctacggaattgatgcggcattggtatttttaatttacccaaaaagtctgatcctttggttagttgcgggtctagttttatttatttttaatatccaacaccgccaagttactcgaggaatctatcaattattagcgaccatttttggttttcttctgattctatatgcggtaggttattatgcttttgaggcgcagattctggggacagctattcaacaaactttcctttataacttacagttagactttcaccattcctatctatatttagccttggcgattgtgtctgtatttttactcttatctggattctttaaaagtttcatccaaatggtgttttctttcaaacaaggaagacatacctatatcaaagttctcctattattgactttcttagttcaatgtgtctttattattgggaatgcaaactttcaatggagccaactcattcttcttttaccgtatggttttgcgatgtcagtcgtttacctgcgtgatgaggatgtagaagattatagtgggtatttgcgtcgtcaattctttcttccgttagctatttgcttgggtattatcgctcaacctgtttatctttatttggtacagggagatttgagaactgaccgtgaacaagttgccaattacattgatgaacaaacaaaagattcggataagatttatgtttgggataatagcgcaagcatctatctttcaagtcaacgtttatctgctgcaacgattactacagcagaaccctatctgaatactgacgacaataaaaatagcttgatgtatgacatcaataaaaatgaggcaaaatttgtagtcgtcaataagaatttgccaattctagatgaaatcaagacaaatttagaatcacagtaccagtctgttcagacaacggattactttacgatttatcaaaagaatgaatgattgctcaggcagtcattttttctttagcctatctgggaaaaggagggaaagtggatatgtggtataatggaaaaataagcattcgggaaaaattattaaagaaatgtaggagaaatgatgtcacatattattgaactaccagaaatactagccaaccagattgcggctggtgaggtcattgagcgaccagccagtgtggttaaggagttggtggaaaattccattgacgcaggggctagtcagattgaaattagtgttgaagaggctggcctcaaaatgattcaaattacggataacggtgaggggattgcccctgatgaagtagcgcttgccctccgccgtcacgccaccagtaagataaaaaatcaatcggatttgtttcgtattcgcaccctcggttttcgtggagaagccctgccctccattgcttctgtcagtcatatgatcattgagacagctacggcagactctgcacacggacttcatttggaggccaaaggtggtgtcatcgagaaagaggagccagttagtcgtccagttggtacgcagattactgtttcggatttattttacaatacccctgctcgtctcaaatatgttcgcagtcaacaggctgaattatcacatattgttgatgttgtaaatcgattgagtctagctcatccggaaatagcctttgtcttagtaaacgaaggacgagaattaattagaactgcagggacagggaaacttcgtcaggcaatttcagggatttatgggattgcttctgccaaaaaaatggttgaaattgaggcagaagatctggattttcagatttcaggttatgtttccttgccagagttgactcgtgccaaccgcaactacatttccatttttatcaacggtcgctatatcaagaattttttgcttaatcgagcgattttggaaggttacggcagtaagttgatggttggacgctttccgctggcagtcatttctatagaaattgacccctatcttgctgatgtcaatgtgcatccgaccaagcaggaagttcgcatctccaaggaaaaagaactcatgaccttgattcgagaggcgattagtcaagcacttaaagagcaggacttgataccagatgctcttgagaatttagctcagtcaagtactcgaccaaaagtaaaagcagagcaaggcaccttaccactcagagagccaaaaatctattatgatacgattaagcaagacttcttcttaaaaccagacgtggtcgctgaggatgtcaaacctctcgaagaggataggcaagagattgttgagtcgcctgtcgaaaatagacctacatctgttcaatttgcagaacgtcagtcggtggaatcagaagatcaggagcatcctaatctaagtgcaaaagaattggcaaaactggcagataaattagaccgggaggaaacatcgacatttccagagttagaatattttggtcaaatgcatgggacgtatttatttgcacaaggcaagacaggactttatatcattgaccagcatgccgcacaagagagggtcaaatacgaatactaccgtgagaaaattggacaagttgacaattcagctcaacagttattggtgccgtatatttttgaatttccgcagaatgatgcccttgacctcgtccacaaaatggatgcccttcgtcaagttggtgtcaacttggaagaatatggatctaatcaatttattctgcgtgaacatcctatttggatgaaggaagaggagattgagtctggcatttatgagatgtgcgacatgttgctcttgacggatcaggtgtcaatcaagcagtatcgggcagaactggtcatcatgatgtcttgtaaacggtcaatcaaggccaatcatgctttggatgattattcggcgcgtgatttattgagacaattgtcttactgccaaaatccctataattgcccgcacggccgcccagtcttagtgcattttagcaaatcggatatggaaaaaatgttccgtcgcattcaagaaaatcacacgagtttgcgtgaattagggaagtattaacatagttgaaaaagttgacactttagcaaaggaagtatatgtacgactatattaaaggaattttaacaaaaataactgcaaaatacattgtggtagaaacgcaaggagtaggctatatcttgcaggttgctaatccctacgcctattcaggacaagtccagcaagaagtgactgtctatactcatcaggtgattcgtgaagatgctcatttgctctacggatttgctacagaaaatgaaaaatccgtctttctgagtctgatttcagtatcaggtattggtccaacaacagctctggctattattgctgttgatgataatgatggacttgttcgtgctatcgagcagaaaaacattacctacctgaccaaatttccaaagattggcaagaaaacagcccagcagatgattttggacttggaaggcaagtttgtcatgagcgaagaagcgggtcctgttcaacaagtagcaccatccagtgaaaatatcgcccttgaagaagccatggaagccatggaagcccttggttaccgcccagccgaactcaagaaaatcaagaaattctttgaaggcaccaacgacactgcagaaaactacatcaagtcagcccttaaaatgctgatgaagtaataagatacaaaggacgtaaaggacaaagagaaaatagacggccgaacagaaattttgctagaaatttagttgtgagacctccgcaatgacaactaggtaaaaggcgagttttgacaaagccttttgccagatgtcaactgcgttattcggtgatatttaggattcagtttgacaatttttcaaagtatcgtagccgtgttcaactaacgtaccagtatgatggttaaaaagttttgttttgttactcaaagtttgagtcaacatttcagcgcagtggttgattggcagatttgttcgtgttccacacatcaaatctggcctaatcaactgtgcgggggcaggaagacgaattctttttctgcctgtcgaattctttcccgctcccactacagcaatcgctatttgcgacttgcctaggtaccttactaactcgccacaaaaataatgtcgatttttgtggctcatgtcgtgtccagatacaaagggcgtaaaggacaaagagaaaatagacggccgaacagaaattttgcaagaaatttcgttgtgagacctccgcaatgacaactaggtaaaaggcgagttttgacgaagccttttgccagatgtcaactgcgttactcagtgatatgtaggattcagtttgacaattttgcaaagtatcgtagccgtgtttcagtctgtttatcctgattcgtactttagttattcacgaaaaggagtttctatgtcccgttgtgcttgggtcaatcccaacaatccactttatattgcttaccatgatgaagaatggggcaagccacttcacgatgagcagtctttgtttgagttgctttgcttggaatcctaccaagcaggactttcctgggaaattgttctcaataaacgccaggcttttcgctctgcttttttcaactatgatattcaaaaggttgcggccatgacagatagcgagttagatagccttctgaccaatccagacatcattcgtcataaggcaaagctgtacgctacccgcgccaatgctcaggcctttcttcgagtacaggaggaattcggtacgtttgatacgtatctttgggaatgggttaactttacatctatcgacaaccctgtcaagtccttccgagaattgccgaccaagaacgacttgtctgagcggatttcaaaagatttgaagaaacgaggtttcaaatttgtagggcctgtctgtatttactcctatttgcaggctgcaggtctgttgaatgaacacgaagaaacttgcgagattggaaagaaattacgaactaattagatgagcgagcaatcgcaccctagacagaggaggaatatgaaagcagaactaatcgccgttgggacggagattttgacaggtcaaatcattaataccaatgctcagttcctttcggagaaatgtgcagagctgggaattgatgtttattttcatacggcagttggtgacaatgaaggccgtttattatcaacccttgaagtagccagcaagcggagtaatatggtcgttctttgcggtggtttaggaccaactgaggacgacctgaccaagcagaccttggcgaccttcttaggtagaaatcttgtgtttgatgagttggctatggcaaaattagaccgtttctttgccagtcgcccaggtcgtgtccgtacaccaaataatgaacgtcaggcacagattgtggagggaagtcaggcgctacagaatccagctggtttagctgttggtggtatgattgagcaagatggtgtaacctatattgttttgcctggcccaccaagtgagctcaaggccatgttttctgagagtctcttacctttactgtcccaatctcagcagcaactttattcgcgtgtcctacgcttttttggaattggcgaaagccagttggtgactgttttggcggacgtgattgataagcagacagacccaactcttgctccttatgcaaaagttggagaggtgactttacgcttgtccaccaaagcgaccagccaagaagaagcaaatctacgtttaaatcagttggaagaagacatcttacaacatgacaaactggcagactatttctatgcctacggagaggacaatagtttggtcaaaacggtagcgactcgtttggcggagaaaagacaaaccatcgctatcgtcgaacaggggacaggtggtctcttgcaagctgaattgagcctggctttggctgatcagccgtattttagcggaggaaaagtcgtcggtcagctagggatagaatcgggctggctatcagaggaagctgactgcattcggcaggagctgcaagctgatttaggtttggctgtgtctgtgcttatcaaaccggaatcaacagaggacaacgtacttgcaaaagtatacctcactttggctacgccctcgggtatttcccaaaaagagatagatttaggtggttattcgtggcaataccttcgccagcttgcttgtctgcaggcctgggattttgtacgaaacactttgtgaaatagcagatatttgctataatagtttgactaagaaaagaggagaaaatcattggctaagaaaccaggaaaaaaattagaagatattacaaagaaatttggcgatgagcgtaaaaaagcgttggatgatgccctaaaatcaattgaaaaagattttggtaagggtgctgttatgcgtcttggtgagcgtgctgagcaaaaagttcaagtcatgagctcaggtagcttatcaatcgacattgcgcttggagcaggtggctatcctaagggccgtatcattgagatttacggtccagagagctcaggtaagacaactgttgctctacacgcagtagctcaagcccagaaagatggtggtattgctgcctttatcgatgcggagcatgccttggatccagcctatgcggcggctcttggtgtcaatattgatgagttactattgtcacagccagactcaggggaacaaggtcttgaaattgcaggcaagctgatcgactctggtgcggttgacttggttgttgttgactcggttgcagcccttgtaccacgtgcagaaattgacggtgatatcggtgatagccacgttggtttgcaggctcgtatgatgagccaggctatgcgcaaactcggtgcatccatcaacaaaactaagacagtagctattttcatcaaccaattacgtgaaaaagtcggtgtcatgtttggtaaccctgaaacaacgcctggtggacgtgcgcttaaattctatgcatctgtccgtatggatgttcgtggaaacacacaaatcaaaggaacaggtgacaagaaagatcaaaacgttggtaaggaaaccaaggtgaagattgtgaagaacaaggtggctccaccatttaaagaagctgttgttgaaatcatgtacggtgaaggaatttctcgcacaggtgaattgattgagattggtagcaacctcggcatcatccaaaaagcaggggcttggtattcatataatggagaaaaaattggccaaggttctgaaaatgctaagaaattcttagcagataatccagcaatctttgatgaaattgaccgcaagatacgtgttcattatggcttgattgaagcagatggagttgaagaagttgcgaccgaagaagctcctgttgttgcggaagaaatccaagatgttatcctagatcttgatggcggtattgaattagaagattaattcctaacaaaatagatttaatattgaaccattgatgcatatctgttataggtgtgtatgaagttgtttagtataagaacgaaaaagtctggagattccaggcttttttctaataaaaaccgaatttttaccccaaaatttaaagtttttttaaaaaataggtctgcagaccgagggaatttatgatataatagtctataatgtgcttaataaaatgtagcaaaggagtgactacatgattaaaatttatactgtatctagttgtacttcttgtaagaaagcgaaaaattggttaaatgctcaccaattatcttataatgagcataatcttgcgaaggaagccattactaaggaagaaatcctaaacatcttaacaaaaacagagaatggtattgcaagtatcgtatcgtcaaaaaaccgttatgcaaagagtctggacttcgatattgaagagttgagtgtgaacgaggtcattgatttaattacctctaacccacgtattttgaagagtccaatcttgattgatgagaaacgacttcaagtgggctataaagaagatgatatacgcgctttcttgccacgtgcagtgcgcaatgttgaaaatgctcaagctcgtatgagagcagctctataagatgtacaaaaggactcttttggggttctttttgcgcattttttgagaataattaaaatttgtgatataatgtaaaaaatagggaaagaaggtgtaagtatgggatttaccgaagaaaccgttcgttttcgcctagatgatacagataaacaagaaatcagcaagacattgactagtgtttatcgttcgctggaggaaaagggctataatccgattaaccaaatcattggctatgtattaagtggggaccctgcttatattcctcgctataatgatgcccgcaatcagattcgtaagcatgaacgagatgaaatcattgaagaattggtgcgctactatttgaaagggaatgggattgacctctaatgagaataatgggattagacgtcggttccaagacagttggtgtagccatttcagatccgttaggtttcacggcccaagggttggaaatcatcccaatcgatgaagaaaagggcgaattcggtctggagcgtttgaccgaacttgtagaacagtacaaggttgataaatttgttgtaggcttgccgaagaatatgaataatactagtggtccacgtgtggaagctagtcaagcttacggtgatttattgactgagcgttacaaacttccagttgattatcaggatgaacgtttaacaactgttgcagcagaacggatgctgattgagcaagcggatatcagccgaggaaaacgcaagaaagttatcgataaattagcagctcagctgattttacaaaattatttagatagaacattttaaaggagattctaatggcacatcatcatgaccatgaacacgaccacaaccacgacgaacgtgaattgattactttggtagacgaccaaggtaacgaaacactttttgaaatcttattgacgattgacggtcaagaagagtttggtaagaactatgttctcttgattcctgcaagtgcagaagaagatgagaacggagaagttgaaatccaagcctactcatacattgagaatgagaatggcacagaaggcgatttgcaacctatcccagaagacgcaacagcagaatgggatatgattgaagaagtcttcaacagctttatggaagaggaataaaaaggtccgggtggacctttttatcatgagcatgaaaacaagaaagcgaattaaggtccagtggacctttttatcatgagctgaaaatcaaagagcgaattaaggtccggtggagtgaagcagtctgggggagactgtttcagcccgagttaagaaatagcaaggggaggaatgaatcatgagccagaaaatcaaaagggaggccagatgaaagatagttttacagaaagaagtaagaagctgagtgaggaattagagaggtgtctactggctgataaaaatattttggtcatattagacataatggatagactgaatttatcagattgctggctctgtgcgggaactatccgtaatttcatttggaatcaatacagttttgatgaagaaacagatgttgatcttgtgttttttgatgaaaatatttcttatgaagagacaatggaaatagaaagcaatttatatcaaaactatccagcctatcaatgggaattaaaaaatcaagtgtatatgcatatccatagtccgaatactaaaccgtatcaatcatcaagggatgcgattgaaaaatttccagaaagatgcacagcgataggtatttgtcgaacagaaagaaataaattagaaatatttgctccttttggattggatgacatttatgcttaccaagtacggccaacaccacatttcttagcggatcctaatcgcatggaattgtatcgacaaagaattcttaagaaacagtggaaaaagaggtggctatcgctaacagtaaaagagatttaactcccaccaagtaagtaggccaaaaacagtattttttataaactaaaacaatcaactacgggagattatgttatggaatttgaaacggtttgtttgaaggttagaaacttaggtaggctatattgctacttcaaagttaaatttagaacccatatcgaggctataattcgtaaacaggaaagtcaaaaatgtaaatttgatcgtctcctccatgaagatattcatagtttgattcaatcaccgagcttgggtaatgatgagttgctgatgttatggggtctcctgagagattatcgaaaaaatttaatcaatgaccgacttgaaaatatgaaaaattgataagcggacagagttttactggcagtcaaaaaaataattcgagacttacaaggatatttgaaaaaaaacgttgatagttaactcaaataaaaaataagtaatgaagaatcctgaaataaaagttttgggattttttgaatttttgagtaaaaactcttgcaatggcaagtggaatctggtagaatgttctagtgccgtaaaaattacggctgtagctttgatgcaagaggttgcgacacgctcggttgcattgccacgcaacacgtgttggttttcttgtggagctagcctattatgttaaatagacgaaaaggagaaaaagatggcaaacaaaaaaattcgcatccgcttgaaagcgtacgaacaccgtacacttgatacagcagctgcaaaaatcgttgaaactgcaacacgtacaggtgctcaagtagcaggtccagttccacttccaacagaacgtagcttctacacaatcatccgtgcgactcacaagtacaaagattctcgtgagcagttcgaaatgcgtacacacaaacgtttgatcgacatcatcaacccaactcaaaaaacagttgacgctttgatgaaattggatcttccaagtggtgtaaacgtagaaattaaattgtaatcaagtcgcgagcaaaactcagaatcttgatttgagcatgaaaaacgctcgttaaaaactttttaaatacaaaataagaaaaggaatatttttctcatgacaaaaggaatcttagggaaaaaagtgggaatgactcaaatcttcactgaatctggtgaatttatccctgttactgtcatcgaagcaactccaaacgttgttcttcaagtgaaaacagttgaaactgatggttatgcagcagttcaagttggttttgatgacaaacgtgaagtattgagcaacaaacctgccaaaggccatgtagctaaagctaacacagctcctaagcgcttcattcgtgaattcaaaaacattgaaggcttggaagttggacaagaaattacagttgaaactttcgcagctggtgatgttgttgatgtaactggtacatctaaaggtaaaggtttccaaggtgttatcaaacgccatggtcaatcacgtggtcctatggctcacggttctcgttaccaccgtcgtccaggttctatgggtcctgttgcacctaaccgtgtattcaaaggtaaaaaccttgcaggtcgtatgggcggcaaccgtgtaacaattcaaaaccttgaagttgtacaagttgttccagaaaagaacgttatccttatcaaaggtaacgtaccaggtgctaagaaatctcttatcactatcaagtcagcagtcaaagctggtaaataataaggaaaggggaaatcagtcgaaatggcaaacgtaacattatttgaccaaactggtaaacaagctggtgaagtagttcttaacgatgcgatctttggtatcgagccaaaccaagcagttgtatttgatgtgatcatcagccaacgtgctagccttcgtcaaggtactcacgcagttaaaaaccgttcagcagtctcaggtggcggacgcaaaccatggcgtcaaaaaggaactggacgtgctcgtcaaggttctatccgttcaccacaatggcgtggcggtggcgtagtcttcggaccaactccacgttcatacgcgtacaaacttccacaaaaagttcgtcgcttggcacttaaatctgtttactcagaaaaagttgctgaaaacaaatttgtagctgttaactcacttgaattcacagctccaaaaactgctgaatttgcaaaagtacttgcagcattgagcattgattctaaagtccttgttattcttgaagaaggcaacgaattcgcagctctctctgctcgtaacatcccaggagttaaagttgcaactgcaacaactgcaagcgtacttgacatcgcaaatgcagacaaacttcttgtaactcaagcagctatctctaaaattgaggaggttcttgcataatgaatttgtatgatgttatcaaaaaacctgtcatcacagaaagctcaatgggccaactcgaagcaggcaagtatgtatttgaagttgacactcgtgcacacaaactcttgatcaagcaagctgttgaagctgcattcgagggtgttaaagttgcaaatgttaacacaatcaacgtgaaacctaaaacaaaacgcgtaggtcgttatgtaggtcgcacaaacaaagtgaaaaaagcaatcatcacattggctgctgattcaaaagcgatcgaattgttcgctacagctgacgctgaataatcaaaggaggaattaacgtgggtattaaagtttataaaccaacgacaaatggccgtcgtaacatgacttctttggacttcgctgaaatcacaacaagcactccagaaaaaagcttgcttgttgctttgaagagcaaagctggtcgtaacaacaacggtcgcatcactgttcgtcaccaaggtggcggtcacaaacgtttctaccgtttggtagacttcaaacgtaacaaagatggcgttgaagcaatcgttaaaactatcgaatacgatccaaaccgttcagcaaacatcgctcttgtacactacacagacggtgttaaagcttacatcattgctcctaaaggtcttgaagttggtcaacgcatcgtttcaggtccagaagcagatatcaaagttggtaacgcacttccacttgcaaacatcccagtcggtactgttgttcacaacatcgagttgaaaccaggtcgcggtggtgagttggttcgtgctgctggtgcatctgcacaggttcttggtcaagaaggtaaatacgttcttgttcgccttcaatcaggtgaagttcgtatgatccttggtacttgccgtgctactgttggcactgtaggtaacgaacaacatggccttgttaaccttggtaaagcaggtcgtagccgttggaaaggtatccgtccaacagttcgcggttctgtaatgaaccctaacgatcacccacacggtggtggtgaaggtaaagcaccagttggtcgtaaagcaccatctacaccatggggtaaaccagctcttggtttgaaaactcgtaacaagaaagctaaatctgacaaacttatcgttcgtcgtcgcaaccaaaaataatctattcttagttacatagcattctatatcatccgccaactcggtagggtttgttatggactgactattccagcacctcagtttgattgaaatgccagtttgacgcagtggttgattgcagtttctagtagcttagctacgtcgaaacttctaatcaactgtgcgggggcaggacaacgaacacggtaactggggttctgtccatctcccaagccgctgtggtacatattttaaaggagaaaacactaaaatgggacgtagtcttaaaaaaggacctttcgtcgatgagcatttgatgaaaaaagttgaagctcaagcaaatgacgaaaagaaaaaagtaattaaaacttggtcacgtcgttcaacgatcttcccaagtttcatcggttatacaatcgcagtttacgatggacgtaaacacgtacctgtatacattcaagaagacatggtaggtcacaaacttggtgaatttgcaccaactcgtacttacaaaggtcatgctgctgacgacaagaaaactcgtcgtaaataatttaggaggaaaacacaatggcagaaattacttcagctaaagcaactgctcgcacagtacgtgtttcacctcgtaaatcacgtcttgtcttggataacatccgtggcaaaagcgtagcagacgcaatcgcaatcttgaaattcacaccaaacaaagctgcaggcattatcgagggagttttgaactcagcaatcgctaacgctgaaaacaactttggtttggaaaaagctaacttggtagtcagcgaagcattcgcaaacgaaggaccaacgttgaaacgtttccgtccacgtgcgaaaggttctgcttcaccaattaacaaacgcacagctcatatcactgtagttgtggcagagaaataaggaggtaaaaacgtgggtcaaaaagtacatccaattggtatgcgtgttggcatcatccgtgattgggatgctaaatggtatgctgaaaaagaatacgcggattaccttcatgaagatcttgcaatccgcaactttatcaaaaaagaattggctgatgcgtcaacatcaacaatcgaaatcgaacgtgctgtaaataaagtaatcgtttctatccacactgctaaaccaggtatggttatcggtaaagctggtagcaacgttgatgcgcttcgtgctcaattgaacaaattgactggtaagcaagtacacatcaacatcatcgaaatcaaacaacctgatttggatgcacaccttgttggtgagtcaatcgctcgtcaattggagcaacgtgtggcattccgccgtgctcaaaaacaagctatccaacgtgcaatgcgcgctggtgcaaaaggtatcaaaacacaagtttctggtcgtttgaacggtgcggatattgcccgtgcagaaggctactcagaaggaactgttcctcttcatacacttcgtgcggatatcgactacgcttgggaagaagctttgacaacttacggtaaacttggtgttaaagtatggatctaccgtggtgaagttcttccagctcgtaaaaacactaaaggaggtaaataacaaatgttagtacctaaacgtgtaaaacaccgtcgtgaattccgtggaaaaatgcgcggtgaagctaaaggtggaaaacaagtagactttggtcaatacggtcttcaagcaactactagctcatggattacaaaccgccaaatcgaagctgcccgtatcgctatgacgcgttacatgaaacgtggtggtaaagtttggattaagatcttcccacacaaatcatacactgctaaagctatcggtgtacgtatgggttctggtaaaggtgctcctgaaggttgggtagctccagttaaacgcggtaaggttatgtttgaagtagctggcgtttctgaagaaatcgctcgcgaagcattccgccttgctggtcacaaattgccagttaaagttaaattcgtaaaacgtgaagcagaataaggagaagacatgaaacttcaagaaattaaagattttgtaaaagaacttcgtggcctttctcaagaagaacttgctaagaaagaaaacgaattgaagaaagaactcttcgaacttcgtttccaagctgctgctggtcaacttgagcaaactgctcgtttgaacgaagtgaagaaacaaattgcgcgtatcaaaactgtgcaatctgaaactaaataatagattgggaaaggagaatttcaatggaacgcaataatcgtaaagttcttgttggacgcgtagtatctgacaaaatggacaaaacaatcacagttgtagttgaaactaaacgtaaccacccagtctatggtaaacgtattaactactctaaaaagtacaaagctcatgatgaaaacaatgttgctaaagaaggcgatatcgttcgtatcatggaaactcgcccactttcagctacaaaacgtttccgtcttgtagaagttgtggaagaggcagttatcatttaatcaacctgaaaggagaaaattgacatgattcaaacagaaactcgtttgaaagttgctgacaacagtggcgcacgtgaaatcttgacaatcaaagttcttggtggttcaggacgtaaattcgcgaacatcggcgacatcatcgttgcttcagtaaaacaagctactcctggtggcgcggttaaaaaaggtgacgttgttaaagccgttatcgttcgtactaagacaggtgctcgtcgtgctgatggttcatacatcaaattcgatgagaatgctgcagttatcatccgtgaagacaaaaaccctcgcggaactcgtatctttggcccagtggcacgcgaattgcgtgatggcggtttcatgaaaatcgtttcattggcaccagaagtactttaatcaaatagttttaggaaatttgttacaaactaacgaagtctgtgacgggtttagtaaactagaaaacaaactaagtcccctggttaaatcactaaccagggtgcccattagggcgtaagaaattataggagaaatcaaatgtttgtaaaaaaaggcgataaagttcgcgtaatcgctggtaaagacaaaggcgttgaagcagttgtcgtaacagcacttccaaaagtaaacaaagttattgttgaaggtgttaacatcgttaagaaacaccaaaaatcaaacagcgaaaaccctcaaggcgctatcgttgaaaaagaagctccaatccatgtgtcaaacgttcaagttcttgacaaaaatggtgttgcaggacgcgttggttacaagtttgtagacggcaaaaaagttcgctacaacaaaaaatcaggcgaagtgcttgattaatcacgaaggaaaggagaagtataatggcaaatcgtttaaaagaaaaatatcttaatgaagtagttcctgctttgactgaacaatttaactattcttcagttatggctgtgccaaaagttgataagatcgttttgaacatgggtgttggtgacgctgtttctaacgctaaaaaccttgagaaagctgctcaagaattggctttgatctcaggtcaaaaaccacttatcactaaagctaagaaatcaatcgccggcttccgtcttcgtgagggtgttgcgatcggtgcgaaagtaactcttcgtggcgaacgtatgtatgaattcttggacaaattggttacagtttcacttccacgtgtacgtgacttccacggtgtaccaactaagtcatttgacggacgtggtaactacacacttggtgtgaaagagcaattgatcttcccagaaatcaacttcgacgatgttgataaaactcgcggtatggatatcgttatcgttacaactgctaacactgacgaagaatcacgtgcattgcttactggccttggtatgccgtttgcaaaataagagggagagaataaatggctaaaaaatcaatgatcgctaagaacaaacgcccagctaagttctctacacaagcttacacacgctgtgaaaaatgtggacgtccacactcagtttaccgcaaattcaaattgtgccgtgtatgcttccgcgacttggcttaccttggacaaattcctggcgtaacaaaagcttcttggtaagataagatgtgagagcgtttagcaaccaacgcaaagataggagattttacgacgaagtttacttctaggaaaatctatcttctttgctaagcttgtagctcgaactcaattaaaacatgatactaagggcgtgacggacaaagtgaaaataggaactctagcgaagaacgcttgcgttctagatagagttatctttttcacacaggccgtagcccgagttcaaatgttaggatgcaatagcatcatactagcaaattcaaactttgcattgcctatcaggcacacattaactagcaagtgatctaatcaaactgctagtaagaggagaaacaacaaatggttatgactgacccaattgcagattttttgacacgtattcgtaacgctaaccaagcaaaacacgaagtgcttgaagtacctgcatcaaacatcaaaaaaggtattgctacaatccttaaaaacgaaggttttgtaaaaaacgttgaattcatcgaagatgacaaacaaggcatcatccgtgtattcttgaaatacggaccaaacggtgaaaaagttatcacaaatttgaaacgcgtttcaaaaccaggtcttcgtgtttactcaaaacgtgaagatattcctaaagttcttaacggacttggtatcgcaatcatctcaacatcagaaggtcttttgactgacaaacaagctcgtcaaaagaacgttggtggtgaggttatcgcatacgtttggtaatcttttagcttccaatttcgtcatgtgcctgtgttagagcgtcttgacatactcaagtatggtctgcgtcgctctgccttgtcacatttagaaattgaaacctaaaagcatgatacaaatgcgagaggaccagttcttcgtgcgtgttcaaatctgacttactgattatttggtatcatgcaaccaaactagaacaagattcactaattgaacacgcctacaactctttgaaaaaagtgaaaagtgtttcagaaatccttaccttgttcgtcgtaaacgtctgaactttctctggccttcggtcaggaaagtcctagtcgttctgacgagggtgcgtctgcgaaatcaaagacttcggacttaccgcttatttttcttcgagttgcttaacggctttgtatcttgttcaccccgtgaaaactagtcgcttgacggcttgataatttaacaggagaattaaaaaatatgtcacgtattggtaataaagtaattacattgcctgctggtgttgagcttgctcaaaacaacggcgtggtaactgtaaaaggacctaaaggggaattgactcgtgaattcccaactgctattgaaatccgtgtggaaggtgcagaagtaactcttcaccgtccaaacgattcaaaagaaatgaagactattcacggtactagccgtgctaacctcaacaacatggttgttggtgtttctgaaggcttcaaaaaagaacttgaaatgcgtggtgtcggttaccgtgctcaattggctggtaacaaattgacacttgctgttggtaaatcacatccagatgaagtggttgcaccagaaggtatcacatttgaagttccaacaccaacacaaattgtcgtgtctggtatcaacaaagaagttgttggtcaaacagcagcttacatccgtagccttcgcgctcctgagccatacaaagggaaaggtatccgctacgttggtgaattcgttcgccgtaaagaaggtaaaacaggtaaataatagcttgctgaggtggctggaccacctggctgactatttctcaaattgtttcgtaagaaacagaatcatacattaagaggtgaatattgtgatttcaaaaccagataaaaacaaaatccgccaaaaacgccaccgtcgcgttcgcggtaaaatctctggaactgctgctcgcccacgtttgaacattttccgttctaatacaggcatctacgctcaagtgattgatgacgtagcgggtgtaacgctcgcaagcgcttctactcttgataaagaagtttcaaaaggtactaagacagaacaagctgttgttgtaggtaaactcgttgctgaacgcgcggtagctaaaggtatttctgaagtggtctttgaccgcggtggatatctctatcacggacgtgtgaaagctttggctgaatcagctcgtgaaaacggattgaaattctaatagggaggacactaagaaatggcattcaaagataacgcagttgaaattgaagaacgcgtagtagccatcaaccgtgttacaaaagttgttaaaggtggacgtcgtcttcgttttgcagctcttgtggttgttggtgaccgtaacggtcgcgtaggtttcggtactggtaaagctcaagaagtaccagaagctatccgtaaagcagttgaatctgctaagaaaaacatgattgaagtaccaatggttggtacaacaatccctcacgaagttcgctcagaatttggcggcgctcgtgtattgctgaaacctgcttcagaaggttctggggttgctgccggtggtgcaactcgtgccgtaatcgaattggcaggtatcgcagatgtgacttctaagtcacttggttcaaacacaccaatcaacatcgttcgcgcaacagttgaaggtttgaaacaattgaaacgtgctgaagaagtggctgcacttcgtggcatctcagtttctgatttagcataagaaaggagatactcatggctcaaattaaaatcactttgactaagtctccaatcggtcgcaaaccagaacaacgtaaaacagttgttgcacttggacttggtaaattgaactcttcagttgttaaggaagataacccagctatccttggtatggtgaacgctatctctcacttggtaactgtagaagaagttaaataatctaacaaatagactaagtcgcatagagaaatctttgcgacttctagtccattttacatatttacatacagcgagtttgtggaggaagactcttgtacttcacaggcgctagcatataaaagaggagaaataataatgaaacttcatgaattacaacctgctacaggttctcgtaaagtccgcaaccgtgtaggtcgtggtacatcatcaggtaacggtaaaacatctggccgtggtcaaaaaggtcaaaaagctcgtagcggtggcggtgtccgcccaggttttgaaggtggacaaactccattgttccgtcgtcttccaaaacgtggatttacaaatatcaacgctaaagagtacgcaatcgttaaccttgatcaattgaacgcttttgaagatggtgcagaagtaacaccagttgtgcttatcgaagctggaatcgttaaagctgaaaaatcaggaattaaaattcttggtaacggtgaattgacgaagaaattgacagttaaagctgctaaattctctaaatcagctgaagaagcaatcacttctaaaggtggctcagtagaagtcatctaagaggtggcagcctatgttttttaaacttttaaaagatgccttaaaggtaaaattggtacgtagtaaaattctatttactatctttatcctttttgtcttccgcgtaggaacccacattacagtaccaggagtaaacgcaaagagtcttgaggccttgtcaaaccttccgttcttgaacatgttgagtttggtttcaggaaatgctatgcgtaatttctcagttttcgcactaggtgttagtccttatattacagcttccatcattgttcaacttttacaaatggatattttacctaaatttgttgaatggggtaagcaaggtgaagttggtcgtcgtaaactaaatcaagcaacacgctacatttctttggtactggcatttgttcaatcgattggtattacagcaggctttaatgctttgtccggtgcaaaattgaccaatatgccattaaattggcaaacatatttgttgattggagcgattttgacaacaggttcgattattgtaacctggctgggggaacagatttctgaaaagggctatggtaatggtacatcaatgatcatctttgcaggaattatttcatcgttaccaggaacttttcacgagatttacattgatcgctttgttaatattgaatcaagtcgtttgggggaatcagcaatctttgttgctgcactcgtcgtattaatattctttgttgtgtattttacaacttttgtacaacaagcagaatataaattaccaattcaatatacaaaacgtgcacaaggagcaccttctagctcatatttacccctgaaattgaatccagcaggagttattcccgtaatctttgcaggctcaatcactgcagttccaacttctttgattcaatatttcgcaagtcaaaataagagtgccgggtggttattgacggttcaggaatactttgattattcaactgctaaaggtatgattgtatatgcaggtttaattattgcctttacattcttctacacctttgttcaagtaaatcctgagaagactgcagaaagccttcagaaaagtgcagcctatatccatggagttcgtcctggtaatggcactgaacagtttttgtcaaaattattgacaagattggcagtaatcggtgcactcttcttgagttttgtagctttgctgcctatccttgcgcaaaatctctttgggctttcttcaagcattgcgttccttggtacaagtttgattatcgtaatctctacaagtatcgaaggcatcaagcaattagaaggctaccttcttaagagaaaatatgtaggtttcttagaaattacagaatagaatataggttgacctagtcaaccttctattttgtttttagataagtttgtcaataatggcaaatttatgtgaaaacaaaataaggagtttgtcatgaatcttttaattatgggtttaccaggtgctggtaaagggacacaagcggccaagattgttgagaaattcaatgttgctcatatctcaacaggagatatgttccgtgcagcaatggccaatcagactgaaatgggtattcttgccaagtcgtacattgataagggtgacctcgttcccgatgaagttactaatggcattgtcaaagaacgtttggttcaggatgacatcaaggaaaaaggctttttgcttgatggctatcctcgtacgattgaacaagcccatgccttggatgaaaatttggctgacttaggaattgagttgcaaggtgttatcaatattgagattgatccttcaaaattggtagagcgtctcagcggtcgtattattcataaagaaactggagagactttccacaaagtattcaatccacctgttggagactacaaagaggaagacttctatcaacgtgaagatgacaagccagaatctgtcaaacgtcgtttagaggtcaatatcgcacaaggacagccaatcattgatcattatcgtgcaaaagggctggtccatgatattgaaggtgaccaagacattgaccttgttttccaagcaattgatacagtactatcaaaattgcaataaactaatagatttggcttgcattttttatacaaagatgataaaatagtctagtctgacttataattgttacctctgtgttcagaggacatcaaatcgatatttagagaggggttacttttgcatggcaaaagaagatgtgattgaaattgaaggcaaagtagtcgatacaatgccaaatgctatgtttactgttgagttggagaatggacaccaagtccttgcaactgtttcaggtaaaatccgtaaaaactacattcgtattttggtcggtgaccgcgtaactgttgagcttagtccatacgacttgacacgtggacgtatcacataccgctttaaatagtcgaaatacttggagggattaaacatgaaagtaagaccatcggtcaaaccaatttgcgaatactgcaaagttattcgtcgtaatggtcgtgttatggtgatttgcccagcaaaccctaaacacaagcaacgtcaaggttaagaaatagaaaggagaaaacatggctcgtattgctggagttgacattccaaatgacaaacgtgtagttatttcattaacttatgtttatggtatcggtcttgcaacatctaaaaaaattcttgcagctgcaggtatttcagaagatgtacgcgtgaaagatttgacatcagatcaagaagatgctattcgtcgtgaagttgatgcaatcaaagttgaaggtgacctccgtcgtgaagttaacttgaacatcaaacgtttgatggaaatcggttcataccgtggtatccgtcaccgtcgtggacttcctgtccgtggacaaaacactaaaaacaatgcccgcactcgtaaaggtaaagctgttgcgatcgcaggtaagaaaaaataaaataggaggtagaaaaattggctaaaccaacacgtaaacgtcgtgtgaaaaagaatatcgaatctggtattgcacatattcacgcaacatttaataacactattgttatgattactgatgtgcatggtaacgctattgcttggtcatcagctggtgctcttggtttcaaaggttctcgtaaatctacaccattcgcggctcaaatggcttcagaagctgctgctaaatctgcacaagaacacggtcttaaaacagttgaagttaccgttaaaggcccaggttcaggtcgtgagtctgctatccgcgctcttgctgccgctggtcttgaagtaacagcaattcgtgatgtgactcctgtaccacacaatggtgctcgtcctccaaaacgtcgccgtgtataatcatacattccatacacagcttttcgtttaagagggagtaagaaatgattgagtttgaaaaaccaacaataacaaaaattgatgaaaataaagattacggcagatttgtaatcgaaccattagaacgtggttacggtacaactcttggtaactctcttcgtcgtgtacttcttgcctcacttccaggtgctgcagtaacatcgattaaaattgatggtgtactccacgaattcgacacagttccaggtgttcgtgaagatgttatgcaaattattcttaacatcaaaggcattgctgtaaaatcttatgtcgaagacgaaaagaaaattgaacttgatgtagtaggtccagctgaagtaacagcaggagacattcttacagatagtgacattgaaattgtaaaccctgaccattatctctttaccattgctgatggtgccacttttaaagctgttttgactgtcaattcaggtcgtggttatgtaccagctgaggataataagaaagatgatgcaccagtgggaacacttgctgtagattctatctatacgccagtgaagaaagtcaattatcaagttgaaccagctcgtgttggtagcaacgatggttttgacaaattaacacttgaaatcaacacaaatggcaccattattccagaagatgctttaggtctttctgcacgtattttgatggagcacttaggtctcttcactgacttgactgaagttgcaaaatctgcagaagtgatgaaagaagctgaagtggcttcagatgatcgtatgcttgatcgtacgattgaagaattggatctatctgttcgctcatataactgtctgaaacgtgcaggcattaacactgtattcgacttgacagagaaaactgagccagaaatgatgaaagtgcgcaatcttggtcgcaagagtcttgaagaagttaaagttaaattggctgatcttggtctaggattgaaaaaagataaataatataggaggaaatcatggcataccgtaaactaggacgcactagctcacaacgtaaagcaatgttgcgcgatttgacaactgaccttttgatcaacgaatcaatcgttacaactgaagctcgtgctaaagaaatccgtaaaacagttgaaaaaatgatcacacttggtaaacgtggtgatttgcacgcacgtcgtcaagcagcagcatttgttcgtaacgaaattgcatctgaaaactatgatgaagcaactgataagtacacttctgctacagcacttcaaaaattgttctctgaaattgcacctcgttatgcagaacgtaatggtggatatactcgtatcctcaaaactgaaccacgtcgtggtgatgctgcaccaatggcaattatcgaacttgtataagatcatcaattttgttgagtgttatgatgatggaatcctattctgattcttagtctagctctggtctaccgctgagcttgtctcagcggtaacactcatcatgttgattggacgcttgtttacgaaattactctaagatagaataatttcgtaagcaggcgtttttattttactcaaaaattttgatatactggaggcatacgaagaaaatatacaatctccgattagtatgcctctcagtttttcgccaaatttcataaaaaaatccaaaaaaccggttgacaatgtatataagtcgtgatagaataaatgagttgtctcttgagggactagttaacagaggaacgaaaaaagtttcgaaaaagtgttgacaagaccatcagaagatgatagactaatggagttgtctcttgagggactggttaacagagaaacgaaaaaagtttcaaaaaagtgttgacaaagttcacaagaaatgataaactaagatagttgtcgcgagagcgcgataacgacaagacctttgaaaattaaagaagacgaaccaaacgtgcagggtgatttatctaaagataaatcgtcaatgacaaaacaaaacaataaaacggaaagctagcaatagcttgagtttgaatcaaaactttttatgagagtttgatcctggctcaggacgaacgctggcggcgtgcctaatacatgcaagtagaacgctgaagtctggtgcttgcactagacggatgagttgcgaacgggtgagtaacgcgtaggtaacctgcctcatagcgggggataactattggaaacgatagctaataccgcataacagtatttaccgcatggtagatatttgaaaggagcaattgcttcactatgagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaactgtgagaagagtggaaagtttctcacttgacggtatcttaccagaaagggacggctaactacgtgccagcagccgcggtaatacgtaggtcccgagcgttgtccggatttattgggcgtaaagcgagcgcaggcggtttgataagtctgaagtaaaaggctgtggcttaaccatagtacgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgaccgccctagagatagggtttctcttcggagcatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaaatggaaacctgtacgtcagtcttctttaattttgagaggtcttgtggggccttagctcagctgggagagcgcctgctttgcacgcaggaggtcagcggttcgatcccgctaggctccattaacaacggaagttgttaagattttgtccattgaaaattgaatatctatcaaacattcctaaacgtatgtaaaagtacgtatagaaatagtaacaagaaaataaaccgaaaacgctgtgaatatttaatgagttttctaatttttgaaaaaattaggttaaaacaagttacgaagacgttaaggaaaacgtatgattttaggaaatcatcgcagtagtctaaggactacaagaggatttgtctaaatcactagttttctagtctgagtacgattataaggttaagttaataagggcgcacggtggatgccttggcactagaagccgatgaaggacgtgactaacgacgaaatgccttggggagctgtaagtaagcaatgatccagggatgtccgaatgggggaacccggcaggtaatgcctgtcactcactactgttaaggtagtgaagaggaagacgcagtgaactgaaacatctaagtagctgcaggaagagaaagcaaaagcgattgccttagtagcggcgagcgaaacggcaggagggcaaaccgaggagtttactcctcggggttgtaggactgcaatgtggacttaaagagtatagaagaactacctgggaaggtaggccaaagagagtaatagcctcgtatttaaaatattttttatacctagcagtatcctgagtacggcgagacacgcgaaatctcgtcggaatccgggaggaccatctcccaaccctaaatactctctagtgaccgatagtgaaccagtaccgtgagggaaaggtgaaaagtaccccggaaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcggattagtattatgtcgtagacccgaaaccatgtgacctacccatgagcaggttgaaggtgcggtaagacgcactggaggaccgaaccagggcacgttgaaaagtgcttggatgacttgtgggtagcggagaaattccaaacgaacttggagatagctggttctctccgaaatagctttagggctagcgtcgacatttgagaatcttggaggtagagcactgtttggatgagggggccatctcggtttactgatttcagataaactccgaatgccaatgatttatggtcggcagtcagactgcgagtgctaagatccgtagtcgaaagggaaacagcccagaccaccagctaaggtcccaaaataattgttaagtggaaaaggatgtggggttgcacagacaactaggatgttagcttagaagcagctattcattcaaagagtgcgtaatagctcactagtcgagtgaccctgcgccgaaaatgtaccggggctaaaacaatttaccgaagctgtggataacactttagtgttatggtaggagagcgttctatgtgtgaagaaggtataccgtgaggagtgctggaacgcatagaagtgagaatgccggtatgagtagcgaaagatgggtgagaatcccatccaccgtaagactaaggtttccaggggaaggctcgtccgccctgggttagtcgggacctaaggagagaccgaagggtgtatccgatggacaacaggttgatattcctgtactagagtatgaagtgatggagggacgcagtaggctaactaaagcgggcgattggaagtgcccgtctaagcagtgaggtgtgatatgagtcaaatgcttgtatctgtaacattgagctgtgatggggagcgaagttaagtagcgaagttagtgacgtcacactgccgagaaaagcttctagcgatgtatcatactctacccgtaccgcaaaccgacacaggtagtcgaggcgagtagcctcaggtgagcgagagaactctcgttaaggaactcggcaaaatgaccccgtaacttcgggagaaggggtgctggcttaaagtcagccgcagtgaataggcccaagcaactgtttatcaaaaacacagctctctgctaaatcgtaagatgatgtatagggggtgacgcctgcccggtgctggaaggttaagaggagggtttagcgcaagcgaagatctgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctacgaagtcgggacgccagtttcgactgaggcgctgttgggatactacccttgtgttatggctactctaacccggataggttatccctatcggagacagtgtctgacgggcagtttgactggggcggtcgcctcctaaaaggtaacggaggcgcccaaaggttccctcagaatggttggaaatcattcgcagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggacgggataaacgctgaaagcatctaagtgtgaaacccacctcaagatgagatttcccataactttatgttagtaagagccctgagagatgatcaggtagataggttggaagtggaagtgtggcgacacatgtagcggaccaatactaatcgctcgaggacttatccaaagaaataaactagagtcaatattgacaagcgatcggtttcttgttagaatatagatattcaattttgagttgacaagactcagtagttaagtgacgatagcctaggagatacacctgtacccatgccgaacacagcagttaagccctagaacgcctgaagtagttgggggttgccccctgttagatacggtagtcgcttagcaaattgggagtttagctcagctgggagagcatctgccttacaagcagagggtcagcggttcgatcccgttaactcccatataagcgggtgtagtttagtggtaaaactacagccttccaagctgttgtcgcgagttcgattctcgtcacccgctttgaacatagttcatacccaaacttggtttgggcgcgtagctcagatggttagagcgcacgcctgataagcgtgaggtcggtggttcgattccactcgtgcccattatatggtccgttggtcaaggggttaagacaccgccttttcacggcggtaacacgggttcgaatcccgtacggactatattattcggaggattacccaagtccggctgaagggaacggtcttgaaaaccgtcaggcgtgtaaaagcgtgcgtgggttcgaatcccacatcctccttactattatcgcgggatggagcagctaggtagctcgtcgggctcataacccgaaggtcgtaggttcaaatcctgctcccgcaatttctttaagaatttggctcggtagctcagttggtagagcaatggattgaagctccatgtgtcggcggttcgattccgtctcgcgccattaatttaatattatatttcggagagatagcgaagaggctaaacgcggcggactgtaaatccgctccttcgggttcgggggttcgaatccctctctctccatacctttacgggcatagtttaaaggtagaactaaggtctccaaaaccttcagtgtgggttcaattcctactgcccgtgttatatggcgggtgtggtgaagtggttaacacatcagattgtggctctgacattcgggggttcgattcccctcactcgcctattttaatattggggtatcgccaagcggtaaggcaagggactttgactccctcatgcgttggttcgaatccagctaccccagttcaactatatgccggcgtggcggaattggcagacgcgctggactcaaaatccagtgtccgcaaggacgtgccggttcgaccccggccgccggtatagtttaaaagacaaggtttctaagccttgtcttttgttttatcttttctattgctctttttcaagttgccaaaaaattccattttctaaaaaatatcgtccaatttgttcgccaatgtcttttgtttactagggtataagtgggaatatgtatctattgtagtcgtgatagaggcgtgtccaagacgttcttttacgactagataatcttccccttgattgataagtaaagacgcgtgagagtgccttaaatcgtgtattcgtatcttttttagatagtcgttcctagccagtatctgcttaaattttttatcaatcatattttttgtcattggtagtggtgtgctttgaattacttgaaggttttctgtatctgttgtaaattctttaagtaagtctttttgtttttctttccagtctgcaagcattcttgctaatttatgattgattgtaatacgtctggtacctgctctagtttttgtactattgatatgatttgtaccgttaacaaagtatgctgtttttgtaatgtgaatgctattagtgattaagtttatatcgtaccaagttaacgcaactatctcgcccaatcgcatgccagtaaaaaaggcaatcgtaaagaataggtcataacttatttcatcacttgtaataagttttctaaattcgttaaattcttctacattccaaaaatttatagttggcttactaataggtaattttcttatattttcaactggatttttatctatcaatgactttcttacaccagtatcaaaaatctttttgagaagtatcattattttattgactgtattatgacttaacgtagagctatcgttttgcttttttggctttattttgagatactctcgaaattcaaaaatgtgctcataagataatttgtttaagtttgtatttatgaagtaaggtttgatatgtcgctcatagttgtttctttgtgtgctgatataactgatttttctgttattttgtcggtcttcttcctcaagtatatcgaagagcatatcggttgttaccaaaaaatcaaaacgtttttcttttaactcaacaacacggatatattgttctaactctaaagcttctttcttggtcttgaaacctttacgaatgattcgtatccgctttttggtaactgggtggaagccgtcagaaatatcaacagtccaagttccattttttgctttcttaactgtcatgatgagcacctaaagaaacgtcaaaaccaagtaattcagtagcgatagaagcagggatagttccgacacgcttattttgataaaccctaaaccctcttgctattagaagctctttcccctgtctgatgatacgtttagaagttccttcagagaaaccaagggcaactaggtcattcttatttacggttgctatcattgaacactttcctttcttttgttataatctagttagttaatttttagaggcgacttgttttcaagtcgtctttttttgtccccataagggagaactattctgctctcgaatatattgctctatatccttttcatcattatcagttagccttgacaagccctcttttagtagaccttgaatgtagtcctctgccttttgaacatcataggcttgatattttgctgtatagacttttgccaatgtcttcgcaacttgtttctctgtccaagcctctgactgccgtaatgtaggcttagttctctcaacgctcaaaacagtctgattttcggtctttagatagtctagccaccacttgaccttttttcttctccaacgattagtatctgtcgcatttggtttcacaaaacgatagtgaccattgatagcttcaaaatagatagatgacagaggacgctttagaaacaattgctctgcaataatattcgccttatcctgccaacatctaagttccgcacgaatccatgagggatattctacaagctcttgcttgctaagttgttccatacgtttgttgtagatacaccattgttgattacctctggaacctatagcaaccgtctctccaactcgttctccattttctaagacagatttctcatgatactcaaaatgctttgctttcgagatacataaacctttcttgcaatagtcatatactcgctgaacatctaaactaccgtcaaatatgtcgtgagcaatatctaagcgagtaaaattaaccgaatactgatacaaccgacctatcaaagctatccaattattttcgttaccgtccaaaaattcttcatattggcgacaaccttgcccttttaattcgataaaaacccccattgaaggtctatcctcattaaagtacactttaatctcagaacaagcataatgtcgctggtacttgtttattccccaattatttaatgtgaaatcttctaaaggaattaaaagaatatcagttaaaacactttctggaggaatatttttaacggttactgcaaaataatcaattctgactgtattcatagggttatgctcctagaattttaatgtcctcacatactaatttaacacctgcccagttacttcgtgccatgttccaagctaaacgaactttcggcttaaccaactcaatcggaacattcaaaagtgattcattttgagcgagcgtagcaaccttatctacattacctacaatttctaggttgatagctttcaagtcatcagtagaaattcccatttcagttagaactttcactttatcggcatcaagggcagtacaagtgattttcgtaacttcttcagttttgattttctcgccattaacctcgttatacctattatttactttagcagatagaataacaatttttttaggcacttcaaactgtgtcatatccaaatcaagttgcccaatcttaagggtagtatctgtcatattgtaagtcataataattactccattttctattcaaaaagtcgtatcctacacgaaaagcgactaaatcccttctcccacaagggtttcaatgacttcggtataaccaacaagccgtaaccccttacgtatcaagggtttagagtacatttcatgtatgtgtgcaccccctattagtaatgggggtatttttctgacctcctgcaaagcagtcggttggctctttctcctagcgaaaagaggaacgctccgctcgattctgccccctgggcaatcgtcccccctatttcgctagtccgaaagaccgtcattattagtttggcagtatatttctaactacctgtaaaaaatcttgttttgttttaacatcgacgaacgggacgatagttagtacaggctcaacagaatttaaaccgtcagcataaaagagtgcttcgcctttcctgtctgaaattgtaggaacattttccagttcacacatactaaaagccattttcaatcggtcgtcccctatatttccgaggtataaaactgctgatatttggtttctaagttcaacaggaatattctctgcatttgggtcttgggtactaaggcagaggtggcaacctgcctgccgtcctttgcgtgcaatcaagcctaagttttgcagaatttcattccatagctctttaccttgtttactagaaccacaactatcacgaatagaagcaagctcatcaataaacaaaaaattaggggtcattcctaaatcataggcatcagcatttagcgaactgttctgcttgataacctcaaaacgttcatccataatttttacaaactgtcttgatagctttgctagtgaagtaggagaagagcctactgaaatttgttttcccagttcttcttggaggagtgccccaagagcatataagtcagctcctttaccatcaacgatagctagataagtatcaataccgcaccctttggcaagtgcattaaataagtaccattgtagagctattgtcttccctgtacccgtccttccatatactcctaaattagtattctgttttagagaaaattgctgagtattggatagtttaactattggcgtaggtatgtcttcaaaaaaatctctagtcaatgtttggctattgaatatatactgctcaatttcttctatctttccaagtttataaataacatggtcaggaaattcatatttggatagtagaggtagacccaaggttggaacaagatattcttcaagattttttagaagttttaaaaacttattcccaaacaatggtacttcgaccattacaatatcattgggcaagatttcaaagtttaatgttgcactattggttactacattatcactttcttcgtataaatttaggccaatcagcatatcaaatagagattctctaacatacagtatattttgaatttttgatataaaaacagacttaaaaaatttttcaatagaacaaattattccaataaatatcaatgaaagcactgatttaatagggattgagtatggagaaacccaagtgtttatcaataacattcctaaaaataaatccattccgactctgctcaaaaacaatcttttagaggttattatataaggattcaacctcactcgtactgcatgattcagcttgattagcttcattatctgtccctccgtggtcattttctgataaataacccaacaataacaataaaagtggaataactaaaaaacctccagctacaaacaaagtatcaaaccacggagacatcgtccctttcatctggaatataatatacaaagaaataactagagcaggataggttatgttgaacataaatttataaattttcataataatttcctttcataaaaccaaagggggaggggttagctcccccttatatcactaagcctcaattattgaggtgtaaaaagaagtttccctgtagccttggtaaatctctttgttcatcaagctaatcctaaattcatcagaaatacggtgtttttgacgattaagaataatgatgttttctgctaacttcttcaaagtaggctcatagattaccccttcaattggcaaattttcctttaaaaaatctctggattcatcatctaaggtaaagtttactgatttgtctgaattaaagctctgtactcgcttaattccattgatatttggcatttccattccttcgctaaggaaaatatctttaaatgttttcatctatttatttctccattttttattttgttgttacagtcaatattcttaaataaattggtgaagctctagccttcattagtattctcctctttgtgtttatgtataaatgtagtatcagtcataaacaacagtaattaagctacagttcctcaatgttaccatgagaaactgtaatcctctactgcattatttctttatagtaagcaaaaataacaagttttagaacatatgacaatctaacttgcctaaccatttcagaagtcataaattctttttgataactttccaatgatgtaataatagaattttccaaaaaaaatcttacagacaaggttccaacatccttatcctttggaatagacgaaatcgaatgtttcatttcattatctaatttatgccaatctttcaaacttaaagatttcgttttttcaaaagcctcttctaaaacacttgatgcagaggcttttaaaatcaaagtcactgaagttgcccctaattcattgtcaacttctttcaaatatgattttgttgcatgttctaaattttctatatcttgttcatttattttagcgtctaacttttcctgaatcactgcttgtattgattctaaccaatacttcgcttcgtaagatagacgtactccaaggtgtgagcgcatttttactcctattattagttttgttgtatttgatatacacattctatcatctatatttgcagaaatcaagtaaaaacaccaaaagatttccaaaaataaaatattctatttcctttacgacagaatggacgtcttaaaatattgatttaataggctttgagtagttgtaagttcttaagtatcaaactcaaaatccagtgtccgcaaggacgtgccggttcgaccccggccgccggtatagtttaaaagacaaggtttctaagccttgtctttttgttttgaggttataaaattttcagttgagttactaaaaattacttaatgttttgttgtataataagttatataagcaagaggaggagccattatatgaagacactttatcattatacaacagttgaaacattgcttctgatattaaattataaaacattgagattcaaaagtttactttatgttgacgatccattagaaccttcaacttcagactttggtaatctaggtggatttaagtatgtgtcttgttggactgatactcctaatagtattccacaatggacaatgtattctgataatatgacaggagtgtgtataggaattagttttgacaaagaaactgatgtctttttaacggaaaaattttctttatctgaatcttctgaaccaattgatatggtaaatgcattacatcctttaaaatcaggcttattagttacaaataataaatatgtgccttctttggaacaaataaggtatactgatgatgtttcattgatcactcctcgagtagtttcttcagatgataaatccacaactattaatttagcttcaaatggtatctataagacaactgattggagttttcaaaatgagcaaagattttcttttcaaatttttccattaccaatagatttagttttggaattaatgaatgcaaataaaggagatttgactgaaataattaatagttttatttctgttaaacctaaagaatactttgatttagatttaaatccgactatattcagtaatatgacaattacgtttggtaaaagatgctctgctgaagataagttgaaagtatcaaaatttttagaggataataaattccatattcctttatttgatagtactgtaaatataaagccttaaattaggtcatctaatttatctgctaaatctttttgcttgcttggatacaagtgagaataggtatcgattgaagttgttataaaagcgtgtcctagcctttctttcacaactaaataatcttcccctcgatttatcaatagagaagcgtgtgagtgcctaaaatcatgtatgcgtatctttttaagagccgcatcacgttcaagaatttttttgtactgcttttctattgaattttttgtaatcgtaatgggactactttgaaacactgacatcgaacagacattagctagagggctggctggactacagttacgaattgaacaaattattctggctcataacttacgctattttgaaatgaactagcaccacgggtggcttatacctttattaacgtatacagactttgtgatatgaattgtattgctcgaaaggtcaatgtcttgccatgttagtgcgagtgcttctctaagtcttagatctgtaaagaataggactgtaaagagtaatttttatttaccattttcaactaaactctttaattctaaatgtactttattgttctcaagttctaccttattttttcgtctcagtctagtttctagttctcgagtcagactagtacttactttgagaatttagcttttaaatattttccttgtttttttgttttctatgtggtatacttaacaagttaattaaaaggttaaggggatgcctatgaatcgtattgcattagaaattgagaagtacctgcacgagattgttttgagttcggagaatcaattagagattttggttggttcttgtcaaagcacggtgaagttgacgaatacgcaggagcatattttgatgcttattgaaaaggctgcatatactaatactgagattgctaaggagttgaatgttagtcaggctgcgatcacgaaggctacaaagtcattagttgctcaggggttattggtggcggttagagatgataaggatgctcgtattgttcgctttagtttgactgaggctgctaagcctattgctgcagagcatgctcatcatcacgcgcataccttggaagcttatgaagagcttttggaaaattatagtcttgaagagcaggagtcaattgctcgattcttaagtgagttagtggagaagattagaaaatagatgagatatattactgtggaagacttgtcgttttactacgacaaagaaccggttttagaacatattcattattatcttgatagtggggaatttgtgactttgactggtgagaatggcgcagccaagacaaccctcattaaggcgactttggggatattgaagcccaaacaagggaaggtttctattgctgagaagagtataaaggggaagaagttgagaatggcctatttacctcagcaaattgcaagttttaatgctggttttccgagcacggtttacgaatttgtaaaatcagggcgttatcctcgacaaggttggtttcgtcgtttgacagctcatgatgaggaacatgttcggattagtttggaatcagttggaatgtgggaacatcgggataagcgcttaggtgctttgagtggtgggcagaagcagcgtgcggtcattgcgcgtatgtttgcctctgatccagatatttttattctggatgaaccgacaacagggatggatgcagggaccaaggatgctttttaccaactcatgcaccattcggctaagaagcatggaaagtcggttttgatgataactcatgatcctgatgagctgaataagtatgctgatcgaaacattcacttggttcgtgatcagcagtctccttggcgttgtttcaatgttcatgaagcggatgaggaggttgcccatgtttgatctatctgtatttcattatgactttatgcagcgtgctttcctggcaatcattgcgatgagtctgttctcgcccattttgggggtcttcttgatactcaggcggcaaagtttgatgtcggatactcttagtcatgtttcgttggcgggggttgcatttggtttggtattggggatttcaccaacgctttcgactgttcttgtcgttattgtggcagctgtatttttagagtatttgcggacaatttacaagaattttatggaaattgggacggctatcctcatgtcgactggtttggctatttcgctcattgtcatgaataaatctggtgggaaatcagggcttagcctggaacaatatctgtttggttcgattgtgacgattagtcaggagcaggtaattgctttgtttacgattgctgtgattgtcatcgtgctgacattgttgtttttacgtccgatgtatattcttacctttgacgaggatacggcatttgtagatgggttacctgtgcgagcaatgtccattgccttcaatgtggtgactggtgtcgccattgccttaatgattcctgcggcaggtgctttgctggtttcaacaattatggttttgcctgcttctattgcattgcgacttggtaagagctttaaagctgttatctttactgggatgggtattggcttttttggaatggttatggggttgctgacttcttactatgcagaaaccccagcgagtgcaagtattaccttgattttcattagtattttcttactggtgaatgttgttcaaaaatttaaaaaataaggagttaagatgaaaaaagttggtttattattcttgtctgtctcagctttgcttttgggtgcttgtggcaatagcacagcttctgaagatgggaagttgaatattgtaacgaccttttatcctgtttatgagttcaccaagcaggtggcaggtgatgaggcaaatgttgatctgttggttaaggctgggacagaggttcatggttatgagccgtcagccaaagatattgctcgtatccaagaggcagatgcttttgtttatgaaaatgaaaatatggaaacatgggtccatgatgttgaaaaatcacttgatacaacaaaggttaatgtgattagtgcgacggaggggatgttgcttttgcctggtggtgaggaggaacatgaaggtcacgaccatagtgaggaggggcatagccatgcttatgacccgcatgtatggttgtctcctgagcgtgccatcacacttgtagaaaatattcgtgatagtttggtagctaaatacccagaaaagaaagatgcttttgaaacaaatgcggcagcctatattgagaaattagatgctttggatgctaaatattctgaaacattatctgctgcgaaacagaaatactttgttacacagcatactgcatttgcatatttggctttggactatggtttgaaacaagtttctattacaggtgttgctgcagatgaggatccaactccatcacgtctagcagaattgacagagtatattaataaatatggtattaagtatatctattttgaagaaaatgcgtcaaaatctgttgcagaaacacttgccaaagagactggggttcagttggacgttcttaatcctcttgaaagtttgacggatgaggatatgaaaaatggtaaggattatatttctgttatggaagataatctgattgcccttgaaaaaacaacttcccaagaaggttctgaaattttgccagaagaaggtgctgagactgcgcaaactgtttataacggttattttgaagatagtgccgtaaaagatcgtactctttcagattatgcaggtgagtggcaatctgtttatccatacttgcttgatggtacactagatcaggtctgggattacaaggctaagatcaaaggtggtatgacagctgaagagtacaagacttattacgatactggctacaaaacagatgttgatcaaattaacattacagataataccatggaatttgtagtgggagataagaaagaaaaattcacgtataagtatgtgggttataagattttgacctacaaaaaaggaaatcgtggtgttcgtttcttgtttgaagcaactgatgcaaatgctggtaactataagtatgttcaatttagcgaccacaatatcgcccctgttaaaacaggtcacttccatatctattttggtggagagagccaagaaaaactcttggaagagttggaaaactggccgacatactaccctgttggtttgactggtttggaaattggtcaggagatgctggctcactaagaataatgagaagactgggcaaggtgttcagtctttcttcttgacaatttttgactacaaatgtaaactgaagttagaaaattattgttgggaggtgaatgtgtggagcagacaatttctgctgcggagtggcaggtcatgcgggttctgtgggcccatcctggtgcgacttctcaggaaattattcaggccttgcaggaaggctttgattggcaggcgacgactattaagacacttttagggcggctgcggaagaaaaactatttgagaatggctaaggaaactagcaagtaccactattatccgctgattagtgaagaggaacatttgcaggggcaggtggagctcttactagctgccatatgttccacaaaacaggggcaactggttgaaaaactgctagacacagggacattttccaaaaaaagcctagaaaatctggccagcaaaatctcgcagttacaaaggactgcacctgagcaaatcgcttgtcggtgcttggctgggcaatgtacctgcgggcatcatcatactcttcgaaaatcaacctcagacgttgttgacttgacttgatgagtgtaaagctcctgtggagctttacagcctactacctgaaaatgcgaaagtagtagggttctatctgctcttggagaaacgaagacgttcgctttatttccaaccttcaaaggttccccgaacctttgaagctagtctgaatctgattttcattgagtataaaaaaggagaaagaacatgaagcaaactttgaaattgaaaaacttatcgtgccaaaactgtgtcaagcatgtgaccaatcacctcttggacttggatggggtggaagaggtgaaaatccagctggaagagcagttggcggaggtggcaacctctgtggcctatgacttggaacggtaccaagaggtgctggaagatactatctatgaagtggaagagttggtataagcgaaaaagcagccgtcgggctgctttttataatgctttgagaaaatgagtcaggtctagttgcgcttgtgcaagtgaaatttggtcccagaagccgtctgatcgaaagcgtggaattaggtggacatggaaatgggtgccagcattaaacaagcgatcgttgcaggctgtggtcacaccgtcaattgccaatgtttgacagagtttttcagtcaaaaatacttccaagtccgatagttcatagcgaatagtaggtgggacttgactgagtgtgtcatagtggtctttgctgataatcaacagatgcccagtttgaatagggtcaatgtcccagaccaccttgaaatattctgtctggtagagaatatctatttcttcaatctgatggcaaaaaatacaggtcatagctgttctcctattgatagaacaaaaggaaatcatggtggatttccttgaaaaatcttaataagtcaacacagaatacttcttcttcccacgacggataacggttaactcgccgtcaatcttgtcactgtcagaaagggtatagtccaagtcttgcacacgctcaccattgacataaatggcaccattttgtacatcttcacgagcttggcgttttgaattgacaataccagaggtaactagaagttccacgatgttaaggttgtcttcagcctgtacagcgtagtttggaacgttgctgaggccttgtttgagttcttttgcggataggtttttgatattgccagcaaacaattgctcggtgatgttaagggcttggttataggcttcttcaccgtggaccaatgtcacgacttccttggccaaaatcttctgagccaggcgttcatgacgggcagcgtcaaattgtttctcgatttcagcaatctcatctaatgacaagaaagtaaagattttcaagaaacgaacggcatcgtcgtccatgacattgagccagaattggtacatttcatacggagaagtcttgtcggcatccaaccaaacggcgttgccttcagacttaccaaatttcttacctgttgagtcggtgataagtggcacagtcatcacgtgaccagacttgtcagccttgcggcgaagcaattcagtacctgcagtcatattgccccactggtcagaaccaccgatttgtagggtcacattgtgcttgtcattgagctcgtagaagtcatagccctgcatgatttggtaggcaaactcggtgtaggaaatccctgtttcaatccgtttttttacagagtctttgctcatcatgtagttgaccgtgtagtatttaccaacatcacgaaggaagtcgataaagctgatgtctgagaaccagtcgtagttgttgaccatttcagccttgttgtcaccattttcaaaatccaagaagcgagagagctgaccttggatttttgttacccagccgtccacggtgtctttggtttgcaagctgcgctccgcatccttgaaggaagggtcgccaatcagaccagttgcaccgccaactagggcataaggcttgtggcctgctaactgcaagcgacggctagttaagatagcaaccaagtgccccaagtgtaaactatctgctgttggatcgtatcctgtgtaataagaaacctgtccttctgtcaatgcttttaccaaggcttcttcgtctgtcgtttgaaagaccaagccacgagcttttagttcttcaaaaatgttcatgtgggctgtctcctttaggtttaatatacaggaccataaaccattttatatgatttttggaccgaacttcattttaaaaaattcctccctattataccacgaaattgcggaaaataaacaaaatttggtataatggaacgataaggagttaatatggcgactaaatcagataagcaagattttaaaaagaaaatcagtgccctaggcttaggggatgtagtaggagttttccttcggacgctgaaattattattcaattcagtagctgtcttggtgttcctattcggtctttttggtgcgggtataggaattggtttcgtggttagtctttttgatgacgttaagattcccaaaacagaggaactggtagcgaaggtttcagaagttagtcggatttccaccgttacctattcggatggtagcttggtgtcggaagttaattcagatctgcttcgtgtacctattacttcggaagaggtctctaattatctaaaacaggctgtaattgcgacagaggatgaaacatttgaaacccacaatggggttgtgcctaaggctgttttgcgtgcggcactgggatcagttggtctaggttcatctagcggtggttcaaccttgacgcagcaattgataaaacagcaacttgtcggagatgctccaacctttacgcgtaaggctaatgagattgtttcggctttggcattagagcggaatatgaccaaggaagagattttaaccatttacttaaatgtttctccatttggtcgaaataatcagggacgaaatattgcaggggtagaagctgcggctcagggaatttttggtaaaccagcgaaagacttgactgttcctcaggctgcttttattgcaggcttaccgcaaagtccgattgtttattctccctatgcatcagatggaacacgtaaatcagatgaagatatggtttacggtattgaacgctatcaagatgttctctttaatatgtatcgggcgtcattcttgaccaaggaagaatacgaaacctataaagcctacgatattaaacaagattttattgctccagctcctgtaatggcggatacgaaagattatctctattacaaggtcatggaagaagcgcaagaggttatgtttgattacctggtgaaacgtgacaaggtttctaaaaatgacttgaaaaatgatgaaacaaaggcatcctatgaggagttggccaagcaagaattgagccaaggtggctacacgattaagagtaccgttgatcaaaaaatctatgcggcgatgcagtctgttgtggcaaactatggatctgttttggatgatggaaacgaatatgtcgagacaggtagtgtgttaattgataatgccacaggggccattttaggatttgtgggtggtcgcgactatgcaaccaaccaaaataaccatgcctttgatacccttcgttcgccagcgtcaaccatcaagcctctgttagcttacggtattgcgattgatcaaggtttgataggttctgccagcatcctttcagattatccaacgaacttttcaagtggacaaccgattatgtatggttcaggacgtggtactggtatgatgaacttacagacggctattgaccgttctgttaacattcctgctttttggacctataagatgatgagaaatgcaggtgtagatgccaaagcgtacatggataaaatgaattatcatattcctatgtacgatattgaaagtgtaccgttgggtggtggtgttgaaatttcagtattgacaaataccaatgcctatcaaactttggcaaatggtggcgtttataacaaacattacattgttgaaagcattactgcctctgatggaacagtagtgtatcagcatgaagcgactccggttcaagtctattctaaagcaactgcaagtattatgaaccagcttttgagacaggttgtcaactctggttatactacgacgttcaagagtcgattgagtggtttaaacccacaggcagcatcatctgatttcgtcggtaagacgggaacaagtaatgaagtcaatgacgtgtggctcatgctatcaacccctagagtaactttaggtacctgggctgggaatgatgataactcagaaatgtatgtctggacaggctaccacaataattcacaatatgtggcccatatggttgatgcgctttacaatgttaatgcggatatgttcgcaggaaaatttgaattagacagtagtgttattgcttctagcgtcgttgcttctacaggtcaacgtgcagggacaacacaggtaaatgggcgccaagtaacagttggcggtgcgatgacaactagttattgggctaaaaatggtgcaccggtaacgagctataacttcatggttggggggacagatagtgatcgagcacaggcttggaatacaattatcggctcccaaacggcaacatcaagtagctcaacccaacgaagcagttcgactcggagtagcacgagttcttcagctaataacacgaaccagtcatcagaaacgcaaacagcaactagtgagcaagcgaataatgattcaccttgatttttcctagtacttgtgctataatggtataaattatttgtcgtgtgtcttgtttgaaatattgtccaaacaaggcttgcagcagttaaatcaaactttttcaaaggaagatttagctgctctttttgtgtctatgaggaatttttttgagaattgttacctattcttaaagattctaaaaattcagaaaaaggatgaatgttggtcatcacatggctgtatataattgaactcgggctacactcctgtagaactttgactttgtttaccccttggcgtcgtaaacgtctgaaccttcttcgacattctgtctagaaagtcctagtcgttctgacgagggtgcgtcaacgaaatcaaagatttcggacttaccgcttattttcttttggagtgttaaacgccctcgtatctttaattgaactcgacctaaaacctgtgtgaaaaagtgtatgaaatatttactttggtttgtcactcccaacgtcgtaaacgtctggtctttcttcgacattctgtctagaaagccctagtcgttctgacgagggtgcgttaacgaaatcaaagatttcggacttaccgcttattctcactttggttttcacggtctcgtatcttattacaaaggagaaaacttttggcaggacatgaagttcagtacggtaagcaccgtacccgtcgtagtttttcaagaatcaaggaagttcttgatttaccaaatttgattgaaattcaaacggactctttccaagactttttagattacggtttgaaagaagtctttgaagatgtacttccagtttcaaactttacggataccatggaattggaattcgttggttatgaattgaaagagcctaaatacacattggaagaggcgcgtgcgcatgatgcgaactactcagctccaatttatgtaactttccgtctggtgaataaagaaactggcgagatcaagacacaagaagtcttcttcggtgagtttccaatcatgactgaaatgggtaccttcatcatcaacggtgcagagcgtatcatcgtttctcagttggttcgttcaccaggtgtctacttcaatgataaagtagataagaatggtaaagtaggttatggatcaacggttattcctaaccgtggagcttggctggaattggaaacagactcaaaagacattgcctacactcgtattgaccgtacgcgtaagattccgttcacaacgcttgttcgtgcgcttggtttctcaggcgatgatgaaatctttgacatcttcggtgatagcgaattggttcgcaataccatcgaaaaagatattcataaaaacccagcagattctcgtacggatgaagcgcttaaggaaatctatgagcgccttcgtccaggtgaaccaaagacagctgaaagctctcgtagtcttttgacagctcgtttctttgacccacgtcgttacgacttggcacctgttggtcgttataagattaataaaaaactcaaccttcgtactcgtttgctcaaccaaacacttgctgagcatgtgattaacggtgagacaggcgaaattgtcttggaagctggtactgtcttgagccgtgacgtgcttgaaaaagtagaagcacaattcgatgagctcaacttggtagaatacattccaaatgacaatgctgttcttcttgagccagttcttttgcagaaattcaagattgtagctcctaaggatccagaacgtgttgtgacggtgattggtaatgctaatcctgcagaaaacgtacgtacagtaacacctgcggacatcttggctgaaatgagctacttcctcaacttggctgagggtcttggtcgtgtagatgatattgaccacttgggtaaccgtcgtattcgtgccgttggtgaattgcttgctaaccaagtacgtatcggtttgactcgtatggaacgtaacttgcgtgagcgtatgtctgttcaagacaatgaagtattgacgccacaacaaatcatcaatatccgtcctgttacagccgcaatcaaagaattctttggttcatctcagttgtcacagttcatggaccaacacaacccactttctgagttgtctcacaaacgccgtttgtcagccttgggacctggtggtttgactcgtgaccgtgctggttatgaggttcgagacgttcactacactcactatggtcgtatgtgtccgattgaaacgcctgagggaccaaacatcggtttgatcaacaacttgtcttcttatggtcacctcaacaagtatggcttcatccaaacaccataccgcaagattgaccgtgcaactggtacagttacaaatgagatcgtttggttgacagccgatgaagaagatgcttatattgtagcccaatcaacatcgccacttgatgaaaacaaccgtttcgttgataagattgttatgggacgtcaccaaggtaacaaccaagagttcccagcagattcagcagatttcatggacgtttcacctaagcaggtagttgccgttgcgacagcatgtattcctttcttggaaaacgatgactccaaccgtgccctcatgggtgccaacatgcaacgtcaggctgttccattgattgatccaaaagcaccttacgttggtactggtatggaataccaggctgctcacgactcaggtgcggcaattatcgctcaacacgatggtaaggttgtttacgcagatgcggacaaggtagaagtgcgtcgtgaagatggctcgcttgatgtctaccacatttctaaattccgtcgttcaaactcgggtactgcctacaaccaacgtacccttgtaaaattgggcgacatcgtagaaaaaggcgacttcatcgcagatggaccttctatggaaaatggggaaatggctcttggtcaaaaccctatcgttgcctacatgacgtgggaaggttacaacttcgaggatgcggttatcatgtctgaacgccttgtgaaagatgatgtctatacatctgttcacttggaagaatacgaatcagaaacacgtgatactaagttaggccctgaagaaatcactcgcgaaattccaaacgttggtgaagatgcccttcgcaacttggacgaaatggggattatccgtattggtgccgaagttaaagagggcgacattcttgttggtaaagtcacaccaaaaggtgaaaaagatctttctgctgaagagcgtctcttgcacgcaatcttcggtgacaagtcacgtgaagtacgtgatacctctcttcgtgtacctcacggtgccgatggtgtcgttcgtgatgtgaaaatctttactcgtgccaacggtgatgaattgcaatcaggtgttaacatgttggttcgtgtttacatcgctcaaaaacgtaagatcaaggtcggagataagatggccggtcgtcacggtaacaagggtgtcgtttcacgtattgtacctgttgaggatatgccatatcttccagatggaacaccagttgacatcatgttgaacccactcggggtgccatcacgtatgaacatcggtcaggttatggaacttcacttgggtatggcggctcgcaacttgggcatccatatcgcaacaccagttttcgatggtgcaagttcagaagacctctggtcaactgttaaagaagcaggtatggactcagatgccaagaccattctttacgatggacgtacaggtgaaccatttgacaaccgtgtatctgttggtgtcatgtacatgatcaagcttcaccacatggttgatgataaacttcacgcccgctcagtcggaccatactcactcgttacccaacagccgctcggaggtaaggctcagtttggtggtcagcgtttcggtgagatggaggtttgggcccttgaagcctacggtgcttcaaacgtccttcaagaaatcttgacttacaagtcagatgatgtgacaggccgtctgaaagcctatgaagccatcaccaaaggtaaaccaattccaaaaccaggtgttccagaatcattccgcgttcttgtcaaagaattgcaatcacttggtttagatatgcgtgtccttgatgaagacaacaacgaagtagaattgcgtgaccttgatgaaggtgaagatgatgacatcatccacgtagatgatcttgaaaaagcacgtgcaaaagccgcagctgacgcagccgcagcctttgcagcagaagaagcagaaggcaaagaataattagaatggatggaacaagttggtccaaacctcagaactgaaagagataagggccaacggtcttccaccgtctgatttatagaaaaatagcttaccagctatccattctgctgattattgttcaagaatttgaggtatgggaatccatcctctcacaagaaaagaaagggattattagtggttgacgtaaatcgatttaaaagtatgcaaatcacgttagcttcaccaagtaaggttcgttcatggtcttacggtgaggttaaaaaacctgaaacaatcaactatcgtacacttaaaccagaacgtgatggactttttgacgaagtcatcttcggtccaacaaaagactgggagtgttcatgtggtaaatacaagcgtatccgttataaagggattacttgtgaccgctgtggtgtagaagtgactcgtgcaaaagtacgtcgtgaacgtatgggacacattgagttgaaagcaccaatttcacacatttggtatttcaaaggtattccaagtcgtatgggcttgaccttggatatgagcccacgtgcgcttgaggaagttatctacttcgcagcttacgtggtgatcgatccgaaagatacaccgcttgagcacaagtcaatcatgacagagcgcgaataccgtgagcgtttgcgtgaatatggttatggttcattcgttgccaaaatgggtgcagaagcgatccaagacctcttgaaacaagtcgatcttccaaaagaaatcgcagctttgaaagaagaattgaaaacagcttctggtcaaaaacgcattaaagcagttcgccgcttggatgtattggatgctttctataaatctggtaacaagcctgagtggatgattctcaatatccttccagttattccaccagatttgcgtccgatggttcagttggatggtggccgttttgccgcatctgacttgaacgaactctaccgccgtgttatcaaccgtaacaaccgtttggctcgtctcttggaacttaatgctccaggtatcatcgtacaaaacgaaaaacggatgctccaagaagctgtggatgctttgattgacaacggtcgccgtggtcgtccaattacaggaccaggtagccgtccacttaaatcactcagccacatgcttaaaggtaagcaaggacgattccgtcaaaacttgcttggtaagcgtgttgacttctcaggccgttccgttatcgccgttggtccaactcttaaaatgtaccaatgtggtgtaccacgtgaaatggctatcgagctcttcaaaccgtttgtcatgcgcgaaatcgttgcccgtgatattgctggaaacgtaaaagctgcaaaacgtttgattgagcgtggtgatgatcgtatttgggatatcttggaagaagtgatcaaagaacacccagttcttttgaatcgcgcacctacccttcaccgtttgggtatccaggcttttgagccagttctaatcgacggtaaagcccttcgtttgcacccgcttgtctgtgaagcctacaacgccgactttgacggtgaccagatggcgattcacgttccattgtcagaagaagcacaagcagaagcacgtatccttatgcttgcggcagaacacatccttaaccctaaagatggtaaacctgtcgtaacaccatctcaggatatggttttgggtaactactacttgaccatggaagatgctggtcgtgaaggtgaaggtatggtcttcaaggatgcggatgaggctgttatggcttaccgcaatggctatgttcacttgcatactcgtgttggtatcgcaacagatagcctcgataaaccttggaaagacaaccaaaaacacaaggtcatgatgacaactgtcggaaaaatcttgttcaacgcaattatgccagaaggtcttccatacttgcaagagccaaacaatgctaacttgacagaaggaactcctgataaatacttcttggaaccaggatcagatattaaggctgccattgcagaattgccaatcaacccaccattcaagaagaaaaatcttggtaacatcatcgctgaaatcttcaagcgtttccgtacaactgaaacatcagcccttcttgaccgtttgaaagacttgggttattatcactcaacactcgctggtttgacagtgggtattgccgatatcccagttatcgacaacaaggctgaaatcattgaagaatctcacgaacgtgtagaacaaatcaagaaacaattccgtcgtggtatgattactgacgatgagcgctatgcagctgttacagatgaatggcgttcagctaaggaaaaattggaaaaacgcctggttgaaaaacaagatcctaagaacccaatcgttatgatgatggactctggtgcccgtggtaacatctccaacttctcccagttggccggtatgcgtggtctgatgtcagctccgaacggacgtatcatggaattgccaatcttgtctaacttccgtgaaggtctttcagtattggaaatgttcttctcaactcacggtgcccgtaagggtatgacggatacggccttgaagacagccgactcaggttacttgactcgtcgtttggttgacgttgcccaagacgttattatccgtgaagacgactgtggaacagaccgtggtcttgacatccgttcaatcacagatggcaaggaaatgatcgagccacttgaagagcgtttgcaaggtcgttacactaagaaaactgttaaacatcctgaaacgggtgccgttatcattggtccaaaccaattgattacggaagatattgcctgtgaaattgtcaatgcaggtgttgaacaagtaaccatccgtagcgtatttacatgtaacactcgtcacggtgtctgccgtcattgttatggtatcaacttggcgacaggtgatgcggttgaagtgggtgaagcagttggtacaatcgctgcccaatcgatcggtgagcctggtacacagcttacaatgcgtaccttccacacgggtggtgtagcctcaaacagcgatattacgcagggtcttcctcgtgtccaagagatctttgaagcccgtaacccgaaaggggaagcggttatcactgaggttaaaggtgaagttatcgctattgaagaagatgcttctactcgtaccaagaaagtctttgttaaaggtaaaactggcgaaggcgaatatgtggttccatttacagcccgtatgaaggttgaagttggggaccaagtcgcgcgtggagcagcccttaccgaaggttctatccaaccaaaacgcttgcttgaagtccgtgatgtcttggcggttgaaacttaccttctttctgaagttcaaaaagtttaccgtagccagggtgtagaaatcggcgacaagcacatcgaggtaatggttcgtcaaatgcttcgtaaagttcgtgtcatggatccaggtgacacagatcttctcatgggtaccctcatggatatcacagactttacagatgccaatgcggaagtggttattgcgggtggtattccggcaacagctcgtccagttcttatgggtatcacgaaggcttcccttgaaaccaactcattcttgtctgccgcatccttccaagaaacaactcgcgttcttacagatgcagctattcgtggtaaacgtgacaaccttctcggtcttaaagagaacgttatcatcggtaagattatcccagcaggtacaggtatggcccgctaccgtaatcttgaaccacaagccatcaatgaagttgaaatcattgaagacacagtagcagaagagcttgctgcagaagcagagcttgaagctgtaactgaataaattaagatggcacatctctctctttgagggatgtgtttttgatattcggaaagaaaccatatatatgacttgataaggaattaacaagcagaatgttttcttaaatcatacaatttcgatataatgtgtacgaaaaaggaagtaatattatgtatcaagttattaaaatgtatggagattttgaaccctggtggttcttagatggttgggaagaggatgttaccagtagggctgcttttgatcgctatgaggatgcactgaatgcctttcaaaaagagtgggtacggctatcagaggattttccaatgaagaaaagtaagaatggaacgatggtggctttttgggatgaatcagaccagcattggtgcgaggaatgcgatgaatatttgcagcggtatcattcgctgatgttggtagaagcgagagaaaatttaccggctggttttattaagcaacctacgcaacctcgtgtacgcccctgcaaattaaaacaaaataattgcgtaaatgaataataaaagaggattgacctttgcgggtcaatcctttttagctgaatctgatagtaaatgcttccgcatcaagttcaacatgctcgccaatccgaatggtaaacagaggctgggtatgggcaaagtccaaatcatagagaacagggctggttttgagagtagggtgcttgtccaaaatcgccagcaaaatctcctccgtcatcttggtctctttaggaaaacgatcgaagacaagagcctgtggatttggataggcttgtaaaagtgcagtcaagtgacgagcgataatgagataatcgtcgtcttccgcctcctctaaaaatagaatatattcgtctggtctgggagcaaactctgttccagtcagtaggttgagatatttccaccaatggcaataccagaggcctggcctggattgtagactttccattctgttgggtaaaaggtgcgaggggcgtctggtaggtaccaagcgtcgctagaccattctggactcggggtcaagtcaaaggagtcttgtgtcacagccttgagccaggcctgagtctggtaatcttgtccctcacgcatcttaaagctgctatagaatggtcccatgtaagtctgtatacctgttttggcatagatggcattgagcagggcagttgtgtccgaataaccacagaaaatctttggattgcgggcaattatgtcaaaattcaaataaggtaatagctcattgcagttgaaaccaccaatggttgtcaaaatggcatcgaccgactcatccgcaaaggctgcttccaagtccgcaacacgactggcaatcggagccgaatcgaacatatcattttcaaaataatgttctgagaaagagagtttgaagcccagattttctagtttttccttggcggcaagattggcctcaaaaccaccaactctttcgatagaagatgacgggctgacaatgcgaatatggtcgcctttttttaattttttcataggaagctccaagcttttttattattttaacaaaaaagtatggaaaatcaagtctccttacgaattgatagggtgaggaggttgtatgattcaagaaaaagcaagaaagatgattgaagaggcggtggcggatagggtcagtgacatttatctggttcctcgtggtgagtgttaccaagtctatcatcgtatcatggacgatcgggaatttgtgcaagacttggctgaggaggaagtaacagccatcatcagccatttcaagtttttagcaggtttaaatgttggcgaaaaacgccgtagccagcagggttcctgtgactatgattatgggagcggagagatttcacttcgcttatcaactgtcggagattatcgtggcaaggaaagtttggttatccgcctgctctatgacaatgacaaggaactcaagttctggtttgaggcggccgagcggcttgcagaagaaatcaagggacgagggctctaccttttttcgggtccagtcggctctggtaagaccacacttatgtaccatcttgctaggctgaaattcccagacaagcagattttgaccatcgaggatcctgttgaaatcaagcaggaggacatgctgcaactccagctcaatgaagccatcggagccacctacgacaatctgatcaaactgtccctccgtcatcgaccagacttgctcatcatcggtgaaattcgggatgcggaaaccgctcgagcagtcattcgagccagcctgacaggagctaccgttttctcaacagttcatgcaaggtctatttcgggtgtctatgctcgtatgttggaattgggtgtcggtcctgaggagttaaacaatgcccttcaaggtattgcctatcaacgtttaatcgggggaggaggtgtggtagattttgcaaagggaaattaccaaaaccattccgcagaccagtggaatgcgcaaattgatcggctttttgcagcaggacatatcagtcttcggcaggcagaaacagaaaaaattacccttggctcgccagcgtaaggtcattgagcttttcaataatctttttgccagtggttttcatctgggggagattgttgatttcctcaaacgcagtcagcttctggcagatccctatacccaggtcttgtcagacgggttgctggcaggcaaacccttttcgagtttgctggcagatttgcgattttcagatgcggtggtcacacaggtggctctagcagaagttcatggtaataccagcctgagtttgattcatatccagtcctatctggaaaatgtcagcaaggttcgtaaaaagctgattgaggtggcgacctatccgattatattgcttggttttctgcttttgattatgcttggcttgaaaaactatcttctgccccagttggaggaaggcaatgcagcgacagtgctgattaatcatctaccgaccatctttttatctctaagtggacttagtttggtggcggtcttagctggtatggtttggtttcgcaaaaccaataaaattaaggtcttttcctgcttggcagctctgccatttttcggaaaactcatccaaacctacctgacggcctattacgccagggagtgggggagtttgattgggcaaggcttggacctgccgcagattgtgggcttgatgcaagagcagcagtcgcagctttttcgggagattggccaggacctggagcagtcgctttccaatggtcagagttttcacgaacacattaagacctacgccttttttaagcgggagctgagtttgattgtcgagtacggtcaggtcaagtccaagttgggtagcgagttgacagtttatgcggctgaatgttgggaggattttttctctcgggtcaatagagccatgcagctaatccaaccgctggtctttctctttgtggccttaatggtcgttctcatctacgcagccatgttgctgccgatttatcaaaatatggagttgtaaaatgaaaaaattagttgaaatgaaggtaaaagggttcactctggtggaaatgttggtcgttttagggatcattagcctgctcttgctcctctttgtgccaaatttgagccagcagaaggatgctattcagaagaagggggatgcggctgttgtcaaagtagtggagagtcagatggagctctatgaattggaacatgacgaggaagcaacggtggcagatttgcaggcgaaaggttatattactgaaaaacaagcaaaacagtatgctacggcgaaaaaataaggcttttaccctgtttgaaagcctgctgaccttgttggttgtcagttttttagctgtttccttatcaggaacagtacaaacggtctttcggtctgttcaggaagaaatttttctctgggaatttgaggccatctataaagacagtcagaaattagcagccagttcccacaaaaaagtgaaccttgctatcggtggacaggaggttacaaatggttatcaggctgtagaggtgcccagaaacgtagaggtcttagaggagaaaactattcagtttgaagaagatggtggaaattcttctctgaccaagattcgttttcaccttagtcaaaaaatagtcacgtatcaattatatatagggagtggtcgctataagaaaacagaagaataaggcttatattttgctagaaagtctggttgcccttgcgactctagtgaccatttgcagcttgattttatcagctgtggatgcaggtcgtaggcgacaggtttgggaattggaacaacaggaggttttcaacttagcacagatggctgtccagacaaaacaagatgacctagccttaaacggagttgcagttcaggttcaacgaactgcggaaagagttgcggttttccatgaaggaaaggaggttttatcggttgttaaaaagtaaaattcctgcttttacactcttggaatgtttggtggttctagtcattctgtcaggtagcctcttgatttttgaaggcttatccaaattactagtccaggaagcgcattatcaaggtcagaccgttcaaaaggaatggttggtcttctctagccaattgcggtcggagtgggaccaggctgaattggtcaaggttgaaaatggcaaggtctatgtcaacaaaggtgaacaggctttggcctttggcaagtcatggtcggatgattttcggaaaacaaatgatagaggccagggttaccaacccatgctctatcaggtggatagcgcagccatttcccaagaaaaccagctggtgcgcatcgactttagctttaaaaacggagaggagcgaacctttatctatgcttttaaagaaaaaagttaaggctggcatcctactctatgcccttttgatgctggctgtttttagtctcttgcttcagttttatctccaccgccaagaggctgagagtcgcttggtacaggtggcaaggcaagaaacgactgcttatatcatggctcagatggtcttggacaaggtcgagcaggacctgcaagtagaaaaaatagttacgggagcggtagtgaatgaaaaggaagcaaatttaaccacaggttctaagcagaaggagaatagaggaagggtctcctttcaagagggacaggctcgttattaacttaaaggagaccaactattggttacagttgagttaacaagtgatggtctgtatacctatcaatttccttttgggctatcatcagaaggagggtgagttgactcgttctcctttttagtgcaaagtctgtgaaattttgataagataggagtatgaattttgaaaagatcgaacaggcttacgacctgctattagaaaacgtacagactatccaaaaccagctaggtaccaatatctatgatgccatgattgagcaaaatgctacttacgtagctggtcagcatgagacggatcttgttgtcaaaaacaatcagaccttgaaacaactagatttaaccaaggaagaatggcgtcgtgcctatcaattcttgctcatcaaggccaatcagactgagcccatgcagtacaatcaccagttcacaccagactctatcggatttatcctatcttttctagtagaccaattggtgccgactcaaaaggtgacggttctggaaattggttcggggacaggcaatctagctcagaccattctcaacgccagccagaaagaattggattatttggggatcgaagtggacgacctcttgattgatttgtcggcaagtattgcggatgtcatgcaggcagatatttcttttgctcagggagatgcggtacgtccgcagattttgaaggaaagtcaagtaattttgggagatttgcctattggctactatccagatgaccagattgctagccgttatcaggtcgccagtccaaaggaacatacctacgcccatcatttgctcatggaacaatccctcaaatatctggaaaaagatggctttgcgattttgttggctccaaatgatttattgactagtccgcaaagcgatttgctgaaaggttggttacaggagcaagccaatattgttgccatgattgccctgccaccaaatctctttgggaagactgctatggccaagtctatttttgtcttgcaaaagaaagctgcaagatcgttgacgccgtttgtttatcccttacaaagtcttcaagaaccagaagctattcagaagttcatgctcaatttcaaaaattggaagcaagagaatgcaatttaagtgaaaatctgttatactagttaggaaaacgctttaaaagaggtaagatatgtcaaaaacaattgcaattaatgcaggtagttcaagtctaaaatggcaactttatcaaatgccagaagaaacagtattagcggcagggattgttgagcgcatcggtttgaacgattccatctcaacagttaagtatgatgggaagaaagaaagtgaagttttagatattcctaatcatacggttgcggttaagatcctcctagaagacttgcttaaacacaacatcattgctgcttacgaggaaattactggcatcggacaccgtgttgttgcaggtggagagattttcaaagaatcagttgttattggaccaaaagaggttgagcaaattgaagaactaagtgctttggcaccgcttcataacccagcacacgtggcggcgatgcgcgcatttgaggaagtactaccagaagttttgaatgtagctgtttttgatacagcctttcacactacgatgccaaagcatgcctatctttatccgattccacaaaagtactataccgaccacaaggttcgtaagtatggagcgcacggaactagccactactatgtagcgcatgaggcagcaaaagttttggggcgtccaatcgaagagttaaaattgattacggcacatatcggaaatggtgtatccatcactgctaactatcatggtgaatctgtggatacttcaatgggcttcacaccactagctggtccaatgatgggaactcgttcaggggatattgatcctgctatcattccttatttgattgcgaatgttgaagaactgaaagatgctgcagatgttgtgaacatgttgaataaacagtcaggcttgttcggtgtatctggcttctcaagtgatatgcgtgatattgaagcaggcatccaagctcacaatccagatgcagtgttggcctacaatattttcattgaccgtattaagaaatttatcggtcagtatcttgcagttttaaatggggcagatgctattgtcttcacggctggtatgggtgaaaatgcaccgcttatgcgcaatgacgtagtagaaggcttgtcttggtttggtattgagttggacccagaaaaaaatgtatttggcaactatggtgacatttcaacggcagaatcaagggttcgtgtcttggttattccgacggatgaagaattggttattgcgcgtgaagttgaacgtttgaaataagaaaaactaactggtagtcggagactgccggtttctcttatagtttatacctttagaaaggtatagtttttagcaagtggtcaaaatatatagtgtgtgatacaatagactagcaaagaaatttgcacagagtagatggtttgcgtcaagtgtatgtggatgggatgttgccacataacgaagctgatctttgcttgcatctgatgtctcctagagtaggaacattggatctggctgagagtagcgcggtaaaccattgcatccgctgtcgaatacacacgacagctccattttttgaaaaggagcattttttatggaaaagaagattccaaaactaacggtgcagttgttggctgctattgcgatgactcttgccttggtcatgattgcggagaaccatttttctgttcgtctttctgataccttgcaggtccagtttacctttatccctaatactattttaggtgcgattgctggtcctgtttgggctgctgtatttgcggcgatttcagacccagcttttgtcttgtttagtggacagagcatgctttttagttttatcttgattgaggcggtatcggcttttatctatggctggttcttctatcgaaaaccgctagacaccaagaacaaggctgattggctctatgttgcaggggttgttgtcttgattcaggttgtgatttcctttatcatgacaccgattgccctccatttccattttggaacaccttggattgttctgtatagcagtcgcttgattaaggcggtttttgaaattccattacgcattgtcgtgactatgcttgtcttaccaagtttacaaaaaatacctgaattggctaagttaatgggcattaaataaaacagtatcaagcaacaagtcatccccctgttgctgcttttgtagagagggaatcatgaattatcaagaaactcgccggtggctatctagtcgtcctgcatcagatttagaaaatggcgttgcacgtgtcaactggattttggaacgcttggacaatccccagcttcaagtgccgaccgttcacttcgtaggtacaaatggcaagggctcgaccctcaacgccttacagtctatcttacggtcttcggattacaccgtcggtcgctttacctcaccgtctatcattgattttcgagagcagattgtatttgagcaggagatgatttcggaggaagattttgcaaggattgtgacagacttgcaacccttgattgaggacttggaccagacggctggactggatgccatctcggagtttgagattgtagtagtggctatgtttgtctactttgcccactaccagcgtcccgacattctcttggtggaggcgggcatgggtggtttgcaggatgcgaccaatgtccttgccccattggcagtagtttgcccgtccatcggcttggaccatcaggcttttttgggagagacccacgctgctatagcccgtcacaaggttgctgtcttgcgtgagcgggttcccctcctctatgcgaccgaccagtcagaagtggtggcagcatttgaggatcacgccagtcagcttcagagtccgacctatgcggtgggacgggagattcttttggaaaatagcagagcaggctttgctgtttcaagtactctcggccgtgtggaagagttaacactgcagatgcagggtcgtcaccaggaggtcaatgcagccttggcagtgacaacagctcagcttctcagccctgattttccaacaattaccaatgaaaccatccgccagggcttgtcccaagccatctggccgggccgcttagagttgattaggcctaatctcatgattgacggtgcccacaataatgaaagtatcgccgtcctgacacaactcttggaagaaaagtatgctgacagggatattgaaatcctctttgcggccatcaataccaagccagtggaccagatgttgtcccagcttagccaatttggacctgttagcgtgacgacctttgacgatttcagagcggtacagttaggagattatccgtcaggctatgaacgagttcagacctatcaggagtggttggagcaggtggacttggacaatcccaaacaactctacctgattacaggctcgctatatttcattacctatgtgaggaagtacattttagaagaacttgtatagaaaaaaggctttgccgggcattcaacccagcaaagtcttttgttttaataatttttaatcaaatcaaccgttgagcggtctagttttttaacgatggtctgcaagaaggcttgggcctctaagaagtcatccatgctgtagagagtttgatgtgaatggatgtagcgagcgcagacaccgatagttgttgatggaacaccatggtttttcaagtgggctgcaccggcatctgttccacctttaccacagtagtattggaatttgacacctgcttcttcggcagttgtgaggaggaagtctttcatgttttttagcatgatgtggcctgggtcatagaaacgaagcagagttccgtcaccaatttttccttggtcgccataaatatcacctgcgggcgagcaatcaacagcgaggaaaatgtctggattgaacttggttgtagaggcatgagcaccacgaagaccaacctcttcttgcacattggccccagcaatcaactgatttggcaaagcttgaccagataggctttctagtagttcggtcaccataaggacaccgaagcggttgtcccaagccttagaaatgacattttttccgttggctgttagaatggtttcatttttgggaatgaggacatcccccggacgaacgccgaacgcccaagcttcgtcataattggcaaaaccagcatcgaaaataatatcagcaatggcaggcatgccaggagcgttagcccctcgtgaaaggtgaggtggtactgagcctgagatggctggaatggtacgaccgtcctgcaactgaagagtgaaggcttggctagaaacaaccagaggattccagccacctagctcaacaacacggaaagtaccgtcaggcttgatttggctaatcataaagccaacttcatccatgtgggcgaccactaggatacgaggagcattttcaacagccgtatccttgataccaaaaattccacctagcccatctgtttcaatgcggtctacatgtggcgtgattttctggcggatgtggttgcgaacctgtccttcaaatcccggtaagctttgtaattcggtaacttctttaatttttccaaaaagagtcattcttcttcctccatgacatgattactactattttatcacgaagagctagacttgtcttgaaaatatagaaaaatatagaaaaatatggatagtattgacaagaatgattgaagtttgctaggatagaaatgcccctcaaaatagagaggggagtgattgttaagtgtgggaagcatttatcgtcatttagtttttcttttattacttcgttaattcgccttgcctaacttcagttatgtctgcggctcattgcctcgtactaaaagtaaactaaaagactatatcacagtttttcttgtatctttgttcgtcagttttctaacagttttgtttgaaagatggctcaacaatcgtgacaatagagtgggatttatgacttagagtttgtgtcaacatctcagcgcagtggttgattggtagatttgttcgtgtttcacactccaaatctgacctaatcaactgtgcgtgggcgagacaacgaactcctttgttctgtctcgctccaaaagaaaaccctcaacgctggtaacgttggggcattttgattgccaagtgttgacaaacatttatcactgtaagaccattctatctatttttaagtcttttgtcaagtggtgcgagtttgtctcaactgtcacaagtccaatggcatttttgggaaaaatcctgggaaatatgataaaatagtcaacatgaaaaagaaaaagacagccttgctagcaggcttattgggggcaggtgtgctcaccgctagtgctcaattttaccgtaaaatccaagaagaccgtaaaaaagcacaggccttgcaggaggtgcgtgactttttcgctgatttaggagagattgccacggtctatgtggatgaaacggcttctacgcagaccactcttatcggaggggttgtgatggaggcaggacaggtatttttgtttgaaaataccaaaggttctattcaatacagggaggaagaaagatgatttttccaacaaatcatgaagaagtagctgccttgattgaagatggcaagccaactgtttttctatttgtgacgacttggtgtggagattgccactatattaaaccgcatgtgccagctatcgaagaagcttttccagatctccgttttgtgcaactggatcgagatgactttatgcctttggcacaggaatgggctattttaggcattccaagtctggttgttttggaaaatggtaaggaaatcggtcgttttgtcgataagaatcgcaagaccaaggaagaaatcatgaacttcttatctggactgggtagataaattagcagagaagctctgccatttcccaaaagaaaggaaagaacatgaagaaatcattaggaaaaatccttctagcacctgtggtgctggggttgagtttgagtcttgctcccttggtgcaggctgagattcaaacagatgttatcaatgaaaaatggggcaagccaacactagtctacggtggaggtttgtcagatgcgcaggcgacagaggttaacaatctatttggtatttcggatgtcaataatgtcagtcgtcaggtggttgttggtacggatatggaccaatatttaggtacatctgaagcggacacagcctccctctattcatctgtcttggtgcaaaagcaggacgctggcaaaggggttgtggtggatattaagacgccacagaacatcaccttgattaccgaaacgcagtatgccaatgcggctattacagctggtgcgacagatgtcttgattgatgtagcttctccgattcaggtaacgggggagtctgctttgacaggtgtttacaaggctctcgcagccaatggtgaaacagttgatacagcccgaactgaagtagcccaacaagagctagagacagtcaatgaagtggcgacggctcatacaggtgacactaattttgatagttcggccttggataaggcagtggcggaaatcaagactgctcttgccgactacaaaaagtccaatggtcaggtggcttctgaggctgacatcaacaccatcatcaatgatgttttggcccaaaacggtttggaaaatgtcatcacagcagatgaagtttcaaaattagttacctttgccaaagcttatcaggaaacctctgctattgattcggctgaggttgctgcccagctcaaccagttcaagcaacaggcggagcaacaaatttcagaagcctataagaatctacaagattcagggattttagaaaaaatcggtgccttctttgaaaatctttggaaaggcttgaccggtctatttgcataaaggagaaatgaaaaagaaatgatttttacatataataaggaacatgtcggcgatgttcttatggtgattgttgcggaggacaagggacaggctgtccagtttgaacgcaagggtcaagtggcgcgtgttttcctagaagaaacaggaaaaacagtggcctggaatatttttgaagcatcaagtttggttgaacttgatggaaatggtcaagttttcttgacagatgaacaagttgcgaccttgaatgctgaattggctaaggaaggttttactgaaagcttggttaacgacaatgctccaaagtttgtagtcggtcagattgtggaattggttcctcatccagacagcgaccacctcaatatctgtcaggtcaatgttggtgacaaaacagtgcaaatcgtagctggtgccccaaatgctgcccaaggattgaaaactattgtggctcttccgggggcaatgatgccgagcggtagcctgattttcccaggaaaattgcgcggtgaagatagctttggtatgatgtgtagtccgcgtgaattggcactgccaaacgcaccacaagtccgtggtattatcgaattagacgactccgcagtggtcggagaggcctttgatccagctaaacactggaaggggtagaaaaagaagaattggtcaggtggccaattcttttatgctggttcaatttttccttcaatagcctgttcgatttcttcggtcgaggcctgttgtgatttgagttggaaataaagactggacaggaaatgctggagattgagccaccggaagtagtctactggttcttgatttggaaagtccagcttgctaatccattccgtcagctcttggcttgacactttttcattcagcaggaggtagacagggatttgtgccagacggatttcctcgccagctgagaaaactttactttgtttagttagacaagtgacaatagtttgccagacttctttgcttttttcagcgggaaattgatcatgacagcttgtggccagaagaaaatctgctccgtgggcagcggtatggatccaaccgagtttttcatcgtagccagaccagtcattttcaatcgtcaaataatccaaggcctgctggaagagtagctcatggtcgtcagtgcttaaaaatgcatgataaatagactctggctcattatcgacagacagcaacagacagtaaagtaggcaagtaaaacttcgtttttgtgtggggccttctagggaaaatggcttggtttcttgagagaattgcagtagcgactgtgcttgttctcttgtaatcaagccctccaaaaagatatggcaaaaactagcatagaccagttcgtcgcgtatagtagggtctggatggccgatgttttccaacaaccaatccagttcggcattggtatatggttgggaggtctgtatcttttccatcaaaaattctttcatgattttcgctccttttctaatccttctacgaatagataagtaggaggatataatatgtataataaaacaattttaatcggtcgcttgacggcccaacctgaactcactcaaacaccaactggcaaaaatttgactcgtgtaactgtcgcagtcaatcgccgatttaagacagaaaatggtgagcgtgaagcagattttctcaatgttattttctggggcaaactggcggagacacttgtttcttatggcagcaagggtagtctgatttctattgatggtgagttgcgaacgcgaaaatacgaaaaagacggcagcaaccactatgtgacagagattctaggccaatctttccaattactagaaagccgtgctcaacgtgccatgcgtgaaaataatactggtgatgacctagctgacttggtcttggaagaggaggaattaccgttttaaagcaatatcagtcccaagaccgatggagtgtattgaaaaataggctatactatagtcaatcctaaatatttttcatatctccttaaaaacaccgacgaaagttggtgtttttggctacttattttctatatttccaccattctatcagcatgataattagagaaagtaggagaactccgtagaagaaaaagatgatgtaatgagggtgggaaaagagaagccaccagactagccagagtaggtaggcgaatatcattttcccccaaaagcctaatttacgttttaaaaaccattctgcaaaactttcgtaggctgaaaatcggctttcaaggtaatcaatttttaaatctctaaaaaatttcatgaataccccctaactttttaaaaatagtatagcataatttagcggtaatggataggcaagttctgtctcggtctcaagatggattttcatgaaaaagggatagaatgttcttgactatttttgaccaagtgatacaataggaaatgtgaattagcactcgaatacaaagagtgctaaaaagaccaggaggtaataccatgttgaaaccattgggcgatcgtatcgccgtaaaaattgaagaaaaagaacaaacagttggtggctttgtcctagcaggcgcaagccaagaaaagacaaaagaagcaagtgtcctagcgatcggacaagggattcggaccttgaacggagacttggttgccccagcggtggcagttggagatactgttttgattgatgctcacgcaggattggaagtcaaagacggtgatcagaacgttcacatcatccgtgaaacagatattttggcaattgtagaatagaggtagaaaaatggcaaaagaaatcaaatttgcagcagatgcgcgtgaaagcatggtccgtggtgtcgatattttggctgacacagtcaaagtaaccttgggtccaaaaggtcgtaatgttgtcttggaaaaagcttacggttcaccactcattacaaacgacggtgtaaccattgctaaagaaatcgagttggaagatcattttgaaaatatgggtgctaagttggtatccgaagtggcttcaaaaaccaatgacattgccggtgacgggacaacaactgctactgtcttgacccaagctatcgtacgtgaaggcttgaaaaacgtaactgcaggtgccaacccaatcggaattcgtcgcgggattgaagccgcggttgcgactgcggttgaagccttgaaagcacaagcaagtcctgtatccaataaagctgaaattgctcaggtagcagccgtgtcttcacgttctgaaaaagttggtgagtacatttcagaagctatggagcgcgtgggaacagacggcgttattactatcgaagaatctcgcggtatggaaacagaattggatgtggttgaaggtatgcaattcgaccgtggttatctgtcacaatacatggtaacagataatgaaaagatggtagctgaacttgaaaatccatttatcttgattacagataagaagatttctcatatccaagatattttgccactcttggaaagcattcttcaggccaaccgtccgcttttgattattgctgacgatgtggatggcgaagctcttcctacacttgttctcaacaagattcgtggtacattcaacgttgttgcagtcaaagctccaggctttggtgaccgtcgtaaagccatgttggaagatatcgctatcttgacaggtggtacagtcattacagaagaccttggtttggacttgaaagatgcgaccattgaagcccttggtcaagctgccaaggttgtggtcgacaaagatggtgcaaccattgttgaaggtgctggcaatcctgaagccattgccaaccgtgtggctgttatcaagtcacaaattgaggtaaccacttcagaatttgaccgtgaaaaattgcaagagcgcttggctaaattgtcaggtggtgtcgcagttatcaaagtcggtgccgcgacggaaactgagttgaaagaaatgaaactccgtatcgaagatgccctcaacgcaacacgtgccgcagttgaagaaggaatcgttgccggtggtggtacagcacttgtaaatgttatcgatagcgtagcgaaattggagttgaaaggcgacgatgaaacaggacgcaatattgtccttcgtgccttggaagaaccagttcgtcagattgcctataacgcaggctatgaaggttcagttatcattgataaattgaagaattctgagcttggcactggctttaacgctgcgacaggcgaatgggtcaatatgatggatgcaggtattattgaccctgttaaggtgactcgttcggcccttcaaaacgcagcttctgtagccagcttgattttgacgacagaagcagttgttgccaacaagccagaaccagctgctccagctatgccacaaggtatggatggaatgggtatgggctactaagaaatagcaaaatgacacagctacttggctgtgtttttttcttgaaaatttcaaacatatctatttgacaatggttttgggatgtggtactatattagacggtactttttacttttggtctctcaagagtgtacagggacgtgctgacaaatgttgcaaaagtacacacagataggggttgtcaccaatgccctatcaccaaaaataaaaaatatatacaggagaatgtagatgcctacaattaaccagttggtacgtaaaccacgtaagtctaaagtagaaaaatctaaatcaccagctttgaacgttggttacaacagccgtaaaaaagttcaaacaaacgtttcatcaccacaaaaacgcggtgttgcaactcgtgtcggaacaatgacacctaaaaaacctaactcagcccttcgtaaatttgctcgtgtacgtttgagcaaccttatcgaagttactgcttacatcccaggtatcggtcacaacttgcaagaacacagtgtggttcttcttcgtggtggacgtgtaaaagaccttccaggggtacgttaccatatcgttcgtggtgcacttgatactgctggtgtaaacgatcgtaagcaaggccgttctaaatacggtactaaacgtccaaaaggctaagaagggggaaatataaatgagtcgtaaaaatcaagcgcctaagcgcgaagtattgccagatccattgtataactcaaaattggtaactcgcttgattaaccgtgttatgttggacggtaaacgtggtactgctgcatcaatcgtttacggtgcctttgatcaaatcaaagaagcaactggtaacgatgcacttgaagtatttgaaacagcaatggaaaacatcatgcctgtacttgaagtacgtgcacgtcgtgtcggtggttctaactaccaagtcccagttgaagttcgtccagagcgtcgtacaacacttggtcttcgttggttggtaacaatcgctcgtaaccgtggtgagcacactatgatcgatcgccttgcgaaagaaatcatggatgcagcaaacaacacaggtgcagctgttaagaaacgtgaagatactcacaaaatggcagaagcaaaccgcgcattcgcacacttccgctggtaagataggatattttagcgttaaacaaatgctagccaaaataggaaaattgacgcagaaacttcagtttctaggagattttatctttttggcagacatttgtagctaaaattcaactaagattaagatacgagggcgtcaagcaactcctagacaaaatagggaagcgaagcagattgctgtgcaatcaatgaggttcatctttttgtcagcgagttgtagcccgagttcaattaggatgtaaggacgttaagaaaattcaaggaaaaataggaaatcagacgatggaccttaaggtccaaggaagatttatcttttttccagaatttttagttcgaactcaactaattaagatgtgaggacgttaaatcagttctacataaatcaattgagattatggtagcaacttatcgttcaaccatcacaaatcggattgaggcttgcctcgtccacttcacaccattagtaagaacttaagcgggtgggatttgcccactcgcttttcttaaaatatggtataatcagaatagaaatctaaaaatataggagaacaaacctcatggcacgcgaattttcattagaaaaaactcgtaatatcggtatcatggcgcacgttgacgcgggtaaaacaacgacaactgagcgtattctttactacactggtaaaatccacaaaatcggtgaaactcacgaaggtgcatcgcaaatggactggatggagcaagagcaagagcgtggtatcactatcacatctgctgcgacaacagctcaatggaacaaccaccgtgtaaacatcatcgacacaccaggacacgtggacttcacaatcgaagtgcaacgttcacttcgcgttcttgatggtgcggtaaccgttcttgactcacagtcaggtgttgagccacaaactgaaacagtatggcgtcaagcaactgaatacggtgttccacgtatcgtattcgctaacaaaatggataaaatcggtgctgacttcctttactcagtaagcacactccatgagcgtcttcaagcaaatgctcatccaatccaattgccaatcggttctgaagatgagttccgtggtatcatcgacttgatcaagatgaaagctgaaatctatactaacgaccttggtacagatattcttgaagaagatattccagctgaataccttgagcaagctgaagaataccgtgaaaaattggttgaagcagttgctgaaactgatgaagaattgatgatgaaataccttgaaggtgaagaaatcacaaatgacgaattgaaagctgctatccgtaaagcaactatcaacgttgaattcttcccagtattgtgtggttcagccttcaaaaacaaaggtgttcagttgatgcttgatgcggttatcgactaccttccaagcccacttgacatccctgctattaaaggtgttaacccagatacagatgctgaagaagagcgtcatgcatcagatgaggagccatttgcagctcttgccttcaagatcatgactgacccattcgtaggtcgtttgacattcttccgtgtatactcaggtgtccttaacagcggttcatacgtattgaacacttctaaaggtaaacgtgagcgtattggacgtatccttcaaatgcacgcaaacagccgtcaagaaattgaaactgtttatgcaggtgacatcgccgctgcggttggtttgaaagatactacaactggtgactcattgacagatgaaaaagcaaaaatcatccttgagtcaatccacgttccagaaccagttatccaattgatggttgagcctaaatctaaagctgaccaagacaagatgggtattgccctttctaaattggctgaagaagatccaacattccgcgttgaaacaaacgttgaaactggtgaaacagttatctctggtatgggtgagttgcacttggatgtccttgttgaccgtatgcgtcgtgaattcaaggttgaagcaaacgtaggtgctcctcaagtatcataccgtgaaacattccgcgcttctacacaagctcgtggtttcttcaaacgccagtctggtggtaaaggtcaattcggtgacgtttggatcgaattcacaccaaacgaagaaggtaaaggtttcgagttcgagaacgctatcgtcggtggtgtggttccacgtgaattcatcccagcggttgaaaaaggtctcgtagaatctatggctaacggtgttcttgctggttacccaattgttgacgttaaagctaagctttacgatggttcataccacgatgtcgactcatctgaaacagccttcaaagtggctgcatctcttgcccttaaagaagcggctaaatcagctcaaccaactatccttgagccaatgatgcttgtaacaatcactgcacctgaagataacctaggtgacgttatgggtcacgttactgcacgtcgtggtcgcgttgatggtatggaagctcgtggtaacacacagattgttcgtgcttatgtaccacttgctgaaatgtttggttacgcaactgttcttcgttcagcaacacaaggtcgcggtactttcatgatggtatttgaccactacgaagatgtaccaaaatctgtacaagatgaaatcattaagaaaaacggtggcaatgcataattgtctatctacacctaccttcgggtaggtgtttttttggtacgacggatatgtcacacatctgagcgtgatactcatactcttcgaaaatcaaaattatccgttgtcaacttgccttgatgaactccagttctatcttcggcttcgtttcctaggctacttttgattttcattgagtatcagtagtttatctttgattgcttcgacgagcgaggaaacttcgtttccttatttccaacttcaaacacttcactggagtatttgaactcgctttgtcgtactttacagaagtgatttgcgaggcaagtcttatttccaacctagaacagcctttaggctgttctagcaacttgcagctattgagacgaacttgcttcgccctatctccagccttcaaaggtttcccgaacctttgaagcgagtactaaaaacaaactaaacgactacactatataaaacagatatccgccagattcattttggaaatatacaatgagaaagctacaatttataaaaaattaccctaatttaggtgtggatggctaacaaaagatcagggtttgctattttgggatttcattgggtataagttcctgttgtcgatgaactcaacagtgactcccaggtccgactactgtgaaataaacggattaaaacagtctggggttagactatttcagctcaacaactagaaattaggaattgttgccgaactcttttgatcgttcgagttctcgcctactcacacttaatcagctaaaataaatgttttaaattatttagaattactttgtttgggaatggttataaaaaataagagaattaatagataggctacagaagaaaagcagatataaatgttagaatccttataaggtagatcgatgaaagagtagtttaggaccgctaattactaaaggaggatgcttgtatggtgatgaaatagtggtactaagcacattaacaataaaaagaaaggacagaaaccatgagaaaaaaactaaaattttcattagtagcagtcgcctgtgcgacatttttgacagcctgtggcacaagtaattcctcggctcccaaagcaggtgaagcaacaccacagacggattttcattcttatatcaatgcgcaatggttgaaaaatacaaaattaggtgccggtgaatcgcaaatagataatctgagtcaactctctgagaaaacgcaagaagcgatacaggagatgattgaccagctggatatggactattccaagctgcaagctggtagtgatgagaaaaaacttattgatttttaccgattggcagccgattttgatactcgcaacaaattggggttagagcctattaagccttatctagaggagattaaaaaagcctctaccatggaagaactcaacaagattctggtggccctatacggcaaaaacatccgcaatttgcttcatataaacgttactcaagatataaaagacagtaacaaaaacaccatctacgttgaccctcacgagttaagttttccaaaagaaaattatgatggcacagatgaattttcattgaaaaatcaaaaagcctttaaagcctatctgcaggaagtatttagcttgtcaggagaaacctcaaaagaagcctcttctaaggcagatctcctctttaatttggaaaaagagatggctgcagtgcaacggccaaaagaagaagccaataactttgaagccatgtataacgagaagacttgggatgaggtcaaagcactggttcccaacctaccgattgctgagttggtttctgagttaggacttcagaatgccccaacgacagtcgtatcagatccagatgctctaaaaaaattaaatgaactctatcaagaaaagaatttagacgctcttaaggctctgctccaatatcgtgtgattgcccattacaatgcttatctgtcaagcaatttaatcgaggcaaaagcgaaatacgacggcgtagcaaccggtgcggtagatactccgagtcagaaagaagttgctcaagcggccattgatgcaaatttctccgatatgattggcaaagtttacgttaaacaccatttttcagaagaatccaaggctaatatcctatctatggttcaagagattaaagcgacttatgcagagcgaatcaaagcagtgcagtggatgtctgaagaaaccaagatgcgggccttgaaaaaactagatacattggttgttaaaatcggctatccagaccagtggaaggattactcacaacttgctatccaatccaaggaagaaggggggagtcttctttctaacttcgatatggtaaaaacacttgaattgcgtgaagagatggggcaatttggcaagccttttgataagtcgcagttcggcatgccttctcacacggtgaatgcctattacagcccaactaacaacgaaattgtctttccagcggggattttacaggctcctctctacgatccaaaagctagtcccgaagaaaatctaggtggaatcggggctgttatcggtcatgaaatttcccatgcctttgataaggctggttctcaatttgatgaaaaggggaaccttgtcaactggtggaaaccagaagaccttgaaaaatttaataaaaaggttcaacaggcagcagatatctactctaaattggaagtggctccgggctactatgtcaatggcgaaatttcaaccggtgaaatcatggcggatctcggtggtttaacggttgccattgatattgctcagaaaaaaggctacgatacgaagaaagtcttcgagtcttatggtaaagcatggcgtgaagtcaccaccaaagaatttgctattgccaacatcagcgacgaacatccaccagctaaatatcgggttaacaacattgtcaaccaaattgatcaattctatacagacttcaatgtcaaagaaggggatccaatgtatgtgaaaccagaagaccgcctacgagtgtggtaaaagattatagaggtgtctgcggtccaaaatgggcggtagacacctttttaggtaaaaaatagaagtagcggtaaaccaagaatcggtaaaaaatgtgtcgaggtatggcaatgctattaagttaagtatttaaccagtcataaccacccgagaaaacgcatggctatgatttttaacttttattttttggccttctattttttacataagatgaaccggtaagcagttgcaattttcggtaaatagttatataataaaaacgttgaaaagatgcttgtaggcttacaagttaatattttcacaaaaggattaaaaggcttgccttttaaaataaagaactcgattttcataaggaggaaatcattcatggtagttaaagttggtattaacggtttcggacgtatcggtcgtcttgctttccgtcgtatccaaaacgtagaaggtgttgaagttactcgtatcaacgaccttacagatccagtaatgcttgcacacttgttgaaatatgacacaactcaaggtcgtttcgacggtactgttgaagttaaagacggtggtttcgaagttaacggtaaattcgttaaagtttctgcagagcgcgagccaggaaacatcgactgggctactgatggcgtagatatcgttttggaagctacaggtttctttgcttctaaagaaaaagctgagcaacacatccacgctaacggtgctaaaaaagttgttatcactgctcctggtggtaacgatgttaagactgttgttttcaacactaaccacgacatccttgatggtactgaaacagttatctcaggtgcttcatgtactacaaactgtttggcaccaatggctaaagctcttcacgatgcatttggcgttcaaaaaggtttgatgactacaatccacggttacactggtgaccaaatggttcttgacggaccacaccgtggtggtgaccttcgtcgtgcacgtgctgctgctgcaaacatcgttcctaactcaactggtgctgctaaagctatcggcttggtaatcccagaattgaacggtaaacttgacggtgctgcacaacgtgttccagttccaacaggttctgtaactgaattggttgcaactcttgacaagaaagtaactgctgaagaagtaaacgctgctatgaaagctgctgctactgaatcatttggttacactgaagaccaactcgtatcttcagatatcgtaggtatctcattcggttcattgtttgatgcaactcaaactaaagttatcgaagttgatggcgagcaattggttaaagttgtttcatggtacgacaacgaaatgtcttacactgcacaacttgttcgtactcttgagtacttcgcaaaaatcgctaaataatccttagtgaaaatcgaagaggcttcggcctcttttttgttttgattgctgaaatatagctgtttccttatgctaagaaacaaggatggtataagttgtttctgatttggcaactttagaatttgaaaaatctgattacgaggcgatagtttttagatttcataacatttgtgaaaaaaatatctttatgcaagaaaaaatacagaaaatatgatacaatggtaaagtaaatataatttaaggagttcttatctaatggcaaaattgactgttaaagatgtagaattgaaaggcaaaaaagttcttgttcgtgtggacttcaacgtgcctttgaaagatggcgttatcactaacgataaccgtattacagcagctcttccaactatcaagtatattcttgagcaaggtggacgtgcaattcttttctctcaccttggtcgtgtgaaagaagaagctgacaaagaaggtaaatcattggctcctgtagcagctgacttggcggctaaattgggtcaagacgttgctttcatcgcaggtgctactcgtggtgctgaattggaagcagctatcaatgctttggaagatggacaagttctccttgttgaaaacactcgtttcgaagatgttgatggtaagaaagaatctaaaaacgacgaagaacttggtaaatactgggcttcacttggtgatggtatcttcgttaacgatgcatttggtactgcacaccgttcacacgcatcaaacgttggtatctcagcaaacgtagaaaaagcagtagctggtttccttttggaaaacgaaattgcttacatccaagaagctgttgaaactccagagcgcccattcgtggcaatccttggcggttcaaaagtatctgataagatcggtgttatcgagaaccttcttgaaaaagctgacaaagttcttatcggtggtggtatgacttacacattctacaaagctcaaggtatcgaaatcggtaactcacttgtagaagaagacaagcttgatgtggcaaaaacacttcttgaaaaagcaaatggtaaattaatcttgccagttgactcaaaagaagcaaacgcatttgctggatacactgaagttcgcgatacagacggcgaagcagtttcagaaggcttccttggtcttgacatcggtcctaagtcaatcgctaagtttgacgaagctttgactggtgcgaaaacagttgtttggaacggacctatgggtgtatttgaaaacccagacttccaagctggtacaatcggtgtaatggacgctatcgtgaaacaaccaggcgtgaaatcaattatcggtggtggtgactcagcggcagctgcgatcaaccttggccgtgcagacaagttctcatggatctcaactggtggtggtgcatcaatggaactcctcgaaggtaaagtgcttccaggacttgcagctttgactgaaaaataggcggtaagtcaggaatctatgattccgtagacgcacccccgcaaggctgaataggttggtcacaagcgtagcaaagtgaactgccattcagctactgcgtatgaaagatgaacgatgaaaagagttgggagaccaactcttttctagtacaaaggctagattttctgtgaacgtagtgagtttagaaaatcagcctaggtaaaggctaaaatgcaacggatttccgttgcattttgtgcatcgcgtagagtttctacgaagctaagcgagttagaaagtctagcaaggtgtaaagtgcttccaggacttgcgacggcacggagtgcctagtgccatgcctagtctttctgggaagtgtgacctagaaagactggctaggtgctgccttgactgagaaataggcggtgagtcagttcaacatatctcccagatatgttgaggttagaaatagaagaaacgaagcttctgtcaaaaatgattccgtagattgttactttgatttttcttggtgacaacttcaaatagtccactgggctatttgaaccccgcaaggctgaatcttggtcacaactcccattcagctactgcgctaaaaatataaatgtaaaaaaagacgttgttttttgcagcgtctatttgtttgtcttacttctgggttccttcttgcagctgatttaaagtggcagattattggtttttcgaaaagctggcgtgaacaggaggcttttccagtcgagcttaggagaaaagaaaagctgggcaggtatttgctattctattttccgaaatcatgttagaatagaggcatgtttaaaaaatatacatttgatccaaagaaatttcggttggggatgcggacgttcaaatcgggtttgacagttttcctagttattcttttgtttggttttatgggctggcaagggattcagattgcggctttgacggctgtgtttagtttacgagaagacttcgatcagagtgtccattttggagcttctcggattctgggcaattctattggtggtttttatgcgctacttttctttattttggataggttattcttagatcatttttgggtaactgcggtttttgttccgatatttgtcatgttaacgattatgacaaatgtggcgatgaataataaagcgggaattattggtggagtatcagctttattaattattacattgtctattcctgctggtgatacgattcaatatgtgtttattcgtgtgtttgaaacctttatcggagttttcattgcgattctagttaattatgatgtgaatgttataaaaaaacgttttcaggataaatgatgttataaaatataacatcacctattgacctcaaaaaaaaattctcctataatggtaggcagaaaggagttcattatgagagaaaaagagtttcgtcgttccttagctatctttccgatcggtagtgtgatgaagttgacagatttaactgctcgtcaaattcgttactatgaagatcaaggcttgattaagcccgatcgcaacgaagggaatcgtcgcttgtattctctaaacgatatggacttacttttagaaatcaaggattttttggatgaaggtttgaatattgctgcgattaagaaggaatatgcaaatcgggaagcgaaagctaaggtccaaaaacagcagaaaaccttgactgatgaagatgtccgtcgtatcttacatgatgaattcagtcgtcagggacgattttcaagtcctagttccattttccgttcgtcgtaattagcttttaaaatagaggagaaaaataatgacattcacagtggcagatatcaagcgcgatatcaaagagaaaaacgttaccttcctacgtcttatgtttacagacatcatgggagtgatgaaaaacgtagaaattccagcaactgatgagcaggtcgaaaaggttttgtcaaataaggtcatgtttgatggttcatctattgaaggatttgttcgtatcaatgaatcagatatgtatctttacccagatttggatacatggactatcttcccttggggtgatgaaaatggccgtgtagctggcttgatttgtgatatttatacaacagatgctaagccttttgctggtgacccacgtggaaatttgaagaaatcgcttcgtcacatggaagaggcaggtttctcttcattcaaccttggtccagaaccagaattcttcctctttaagatggacgaacaaggaaatccaacgcttgaagtaaatgataaaggtggttactttgacctcgcaccaacggacttggctgataatacacgtcgcgaaatcgtcaatgtcttgacagagatgggctttgaagttgaagcgagtcatcacgaagtggcagtaggtcagcatgaaattgacttcaaatatgcggatgtcttaaaagcttgtgacaatattcaaatcttcaagttagttgttaaaacaattgctcgtaagcatggcatgtatgcgacctttatggccaagcctaagtttggtattgctggctcaggtatgcactgtaacatgtccctctttgacaaggatggaaacaatgccttctttgatccagaagatcctcgcggtatgcaactgtctcaaactgcttaccatttccttggtggtttgattaagcatgcttataactatactgctattacaaacccgacagtgaactcttacaagcgtttggttccaggctttgaagctcctgtgtatattgcttgggctggtaaaaaccgctcaccattggttcgcgtacctgcatcacgtggaatgggaactcgtttggaattgcgctcggttgatccaactgccaacccatacttagctatggcagttctattggaagttggcttggaaggtattcaaaataaaattgaagcaccagcaccagtagaatctaatatctatgcaatgtctgatgaggagcgtcgtgaagcaggtatcactgatcttccttcaactcttcacaatgcattgaaagctcttcgtgaagacgaggtagttcgtgcagctctaggtgatcatatctatacgaatttcttggaagctaagaaaatcgaatgggcaagctacgcaacctacgtttctcaatgggaaatcgacaactatttggatatgtattaaacaaaggaccccgacgggtcctttgttcacgagccgagaaattggaaatcgggtaatggtccagtggagtgaagtggtctggaaagagactgtttcagtctgagctaataaatagcagggcgaggggatagacatgagcttgaaatctgtcttttttcaagctgggttatcttgttaatataaaataaatcccagaggtttcacctctgggattttagtgtgttatcggtcaggcgtcagaatcattgggataatgattggttcacgctctgttttttcgtataggaatggtcgtagggcgttaacaatggcgccgttgactgtttggatatttgcgtctttgttgcgcatggcgatgcggatagcgttgaaaaggacgcgttggctttcgcgaatgagctcgccagattctctcatatagataaagccacggctgaggatgtctggtcctgctaatatcatcttagaattaaaatcgacagtggctactgcaaggacaacaccatcttctgaaagatcgcggcggtcttttagaacagctgcgccgatttcaccgatgcggtttccatcaacatagatgtcttgggcgttgaattgacctgcgagacgtgcagaatcttttgtcagagcaaggacatctccgttttccatgatgaagatattatctttgggaacgcctgtatcaacagctaggctggcatggattttttgcatgcggtattcaccatggacaggcatgaagtatttgggtttgatcaagcggagcatgagtttttgctcttgttgaccaccgtgtccagaggtatggatgttgttgatcttgccgtgaataacatcgacaccggcttcaatcaagatattgatgagcttgttgacacctgtggtatttcccggaataggactggacgagaagataaccgtgtcgcctggctggagttgcacctgacggtgggtaccgtgggcgatgcgagagagtgcggccataggctcaccctggctacctgtacagagaatcatgatctcgctggcagggtattctttgatctcgtttggctcgatgaaggtatccttaggcaccttgatgtagccgagctcgataccgttaacaatggctttttccatggaacgtccaaagacagcgatcttgcgtccggtcttaaccgctgcatcagccgcctgttggagacggaagatgttggaggcaaaggaagcaaagatgatgcgtccgtgaatgccttcaatcagcttcataatggactgaccgaccactttttccgagttggtgaaggttgggacttcagcatttgtcgagtcggaaaggaggcagagaacgccttcttcacccagggcggccatgcggtgaaggtctgctggctcaccaacaggagtgaagtcgaacttgaagtcaccggtacagacgattttcccttgaggtgtatcaacgacgataccgagaggttctggaatggagtgggtggtacggaagaagctgactttgaggtgcttgaaggtcaactctgtattatgattgatttcatgcaaagtcgcatcacggagcagaccgtgttcttccaatttgcctcgaataagggcgagggctaaaggtccagcatagattgggacattggcctgcttgagtaagaagggaatgcctccgatgtggtcttcgtgcccgtgggtaataaccagacctttaacgcggtctaggttttcaacgatgtaggagtagtctgggataacgtagtcgatacccaataggtcatcttctgggaacttgataccggcatcgacgatgagaatttcatccttatactcgataccgtaggtgtttttcccgatttctcccaaaccaccgatggcgaaaacgccaacttcatgaggttttagattgactgatgacatggattaaaactccgtaattttgaaatctgcgtgctctttctcgtattcaagatgattgtctgataagaggtcgataaattcgatattgtattcagggcggttggtttccaccaattcacgcgcgataatacgaccttccaattctgatgcagcatcgatgtctagataaagagcacgtgtctgctcgcgacgtgggctaatttttgattcttgatagaatactttataaatcatgtgtagtatagttcctttctttttgactggcaactatgaaaaaagcctcaaacagttgggtctgtctggtaatatctattcaattttctcgagttgtcaatttattcagtctaaatgtactcttcattataccataaaatatgctgatggtaaaagggtttggtaggaaaatggaaaagtgtcatgattttcagaaattcggtatttcagaagggtataaatcaaagaaatgagttaggattccgagtgtgttgggattactaagactaagttcaattgtgctgagaaatgcctatcaactgccagatagtgatgtgacttactagaatgacaaatcggttcgatccattaacctactagaaatcacaccccagtcttttccattatttgaaaaaatatccaagatagcttacaatagagagtagcatttaaaagtctttcagtttgcttttagtactaggcaacgagctgcgggctgtactggagtacggcccgcagctcgttgcctagtactaaaagcaaaccgaatgacgtaaagaaagagaaacttatgaaaatactagctttggacagctccaatcaggccttatcggttgccttggtggaggacggtcgtttgcaggcggaaaccctgttggctgtcaagaaaaatcatagtatcagcctcatgcctgtggttgattttttggtagcgcaggtgggctggacacccaaagacctggatcggattgtggtcgctcagggacctggctcctacacgggcctgcgggtggcggtggcgaccgccaagaccttggcctacaccctcaagatcgacttggtggggctatctagtcttcagtctctggttcctcctagcctgacgggtctggtggtgcctctcattgatgcccgccgtaactgcgtctatgcaggtgtttatgaaaatggcagagcagtcgagccagaccgctactggtcttttgaagacttgctttctagcctgtctggtaaggaaaatattacctttgtcggagaagtagaaaactttatggagcaaatcgaacaagctctaccgactgctcagtatcaagctagtctgccgtctgcctatcagctagcagtaatcggtcaagacttgccagcagtagatgtgacgagctttgagcccaactatctcaagcatgtagaggcagaagaaaactggctcaaggacaaccaagttggctcagaaagttatatcaagcgtgtatgatagagattaaacactacgacggtcaggaaaatctggcggaggctgtgttggcagttatgcagtccgtctatgatcagtcaccttggaccttggaacagattgtttcaagcatgaccagtcagtatgaggattattatttggcctatgagggtcaggaattggtcggatttttggctgtgcagacggtgctggatgagatggaaatcttgcagattgctgtcaagactgattttcagaggctgggaatcgccagtcaactgatggctgctgtgatggactgggatggggatattttcctcgaagtgagagagtccaatagcgcagctcaggccctctatacacgccagcattttaccaaaataggaaaacgaaaagactactaccgccatcctgtcgaggacgcggtgataatgaagagagaacgtgatgaaagatagattgattttggcgatcgagacctcctgtgacgagacctcggtggctgttttgcgaaatgacgcggagcttttatccaacgtcattgccagccagattgccagccaccagcggtttggtggggtggtgcccgaggtggccagccgtcaccatgtggaagtgataacggcctgtatcgaggaggccttgttggaggcggaagtgacggcagaggacctgacggctgtggctgtgacctatgggcctggcttagttggtgccctgttggtcgggatttcagctgctaaggcctttgcctgggctaacggtctgccgctcattcctgtcaaccacatggcagggcatttgatggcggcgcgggcggtcaaggagttggagtttccgctcttggctcttttggtcagcggtgggcacacggagttggtctatgtgtcagaggcaggtgactacaagattgtcggtgaaacgcgagatgatgcggtcggcgaagcctatgataaggtgggtcgggtcatgggcctgccctatccagctggtcgggtgattgacgaattggcacatgaggggcaagacatttatgacttccctcgggctatgattaaagaggataatttggagttttctttctctggtttgaaatccgcctttatcaacctctaccacaatgcccagcagaaaggggagaccttgtccaatgcggacttgtcagcctctttccaagcctgtgttatggacattctcatggctaagaccaagaaggccttggagcaataccctgtcaaaaccttggtggtagcgggcggtgtggcagctaatcagggcttgcgagagcggttggctgctgaaattaccgatgtggaggttatcattcccccgcttcgcctctgcggtgacaatgcaggtatgattgccttagcagcggtcagtgagtacaataaggaaaaccttgctggctgggacctcaatgccaagcctagtctggcttttgagaatttatagaataaaaacctcttacgtcaaggatacgtaagaggtttatttgtggatttttcgccagcgatttggagaaatttggtaatgtcttttaaaagcagttgaaaaattgaattggttggagtagccgatttcttcagcaatttcctgtagtgtcttagtagtgttttttaagagttcgcaggcttcgctgagtcggtattggatgataaattgttgaggtgagatgttcatttgctccttgaatagccgactgaagtagtggcgattgaggttgcacacttgtgccaaatcatcgacggatatagctttctcataatttcgttctacgaagttgatagcttctcgtatataaaattccttgttttcatcgtgtttgctacttgttttggttagcgaacagtcaatgaggcaggagataaagaggtaaaggtgtccgagaactagagcgcttttttgatgatggagcgcgagaatttgtttcatttcatggtagacagggctagaggtgggcatttctcgttgtgaaaagataggttgttctttcgagagccctgcctgtctgagaaaatgctcagttttcagaccgtcaaattcaagccagatataggtccaggggtccttttcgtctgcttcgtagctacagatggcgtctggggagataaggaagccctgtcctgcggttaggtggtattcacgttggtcggaggtatcgtaaaaagtacctgaaccagagatgatgtagtgaaacaggtagtgttgtttcatagttgggccgaatgagtgaagtggcttacaggcttccatgccaaattggatggggtaaaaatctacataggatctgttattaaagacgtaaaattcaggttgtattttcatcgtattctccataccaaaagtgtaaaggcttacaattagtatagcatatttatatgtaaatgtgacattttatttgaaaaaattaaaaaatatcccaaaatcatatggaatatgtcaaatattcctatttgattataaagcgcttacatgttatagttatagtagaaataacaaagttcgtcgacgtattcgacaaaagaaaaggagtattatcatgaagaaaattggtcgctatgttaccttgcttgcggctgcaggcctgctggcagcgtgttctacttcgactgagtctagcaaaactacgggaggaagtagttcaggaaagacagaaatatcctatgctatttgggattctggtcaagagcctggtttgagaaagattgcggatgagtttgagaaaaagaatccagatattaaaatcaatattcaagtatcggactgggattcctactggaccatgttagaagctggtgcgacaggtggttcattgcctgataccttctggatgcattcaaatgagatttatcgctatggttccaatgaaatgctattgccattggatgaatacttagccaagagtgaagatgccaaactagctaatttcccagatggtttgaatgaaatctacaacataaatggtaagcagtacgctattccaaaagatttcgatacaatcggtctttggtacaataaaaaattatttgacgaagcaggcattccatatccagatgatacttgggattggaataagttgaaagaagtagcgaagaaattgaccaagccagatggtagtcagtatggtttcggtgctggtttgagtaaccaagagggctactacaactttatctatcaaaatggtggtaaggttattactgatgatttgaaatcaggctatgctgatcctaagaccattgaggctttggattactactttagctttgtcaaagaaaaaatttcaccggctattacagtagataaagagcgggccgaagcattccaaaacggtcaagtggctatgagcgtcttcggttcttggaatttatctggtttcactgctaatgactacattcgtgaaaatgctgatgtagctgttttgccaaaaggtccagatggaactcgtgcaaccatctttaatggattgggtcatgccattgctgctaccactaaacatccagatgctgcttggaaatgggttgaatacctcagctcaaaagaggcacaagaaatgcaggcaacacttggtgtggcaatctcggcttataaaggcgcggcagatacttgggtagattcaaacaaaaactttactatcaagaattatgttgacatggtggattatgcacagattcgtccatattcacaaacaaccatcaagtgggaagataaggcttatgagctattgaaacctgcttatcttggagaaaaagcaactgaagaagctgccaaagaaacagctgatatgatgaatgctgaattagcaactgaaaaataggtaggaggtcttgggaagttgattcttccccggaccttcttattaaaatgaagaaggatggggataagatgttccgaaaaaaaggaagtttaaatgaggcaatttggggatggggaatggtagcaccgaccattattggattaatcgtgctcaatattattcctattttccaaaccatgaagatgagttttcataagagtggagatttcggcaaaggtgacatctttgtcggcttggcaaattaccaacgcatgttaggggatgcgcaagtgtggcaggcgacatggaataccttgaaatatacgattctagttgttccggctaccgttgccttggccatgttgcttgcagttttgcttaattctaagattaaaggtaagcatatttatcgaaccatttttttcttgcctatggtggcagcaccagccgcggtgaccatggtttggaaatggctctacaatacggacttcggcttgattaactatatcttgcgtcgtttgggactgggtgctgtgaactggattgaagatccaaagattgctctatactcaatcgctttgattggaatttggagtacggttggctatagtatgattttaattttagctggtttgcaagaaattccaacggatttttatgaggcagctcgcattgatggagctagtccggccaagcaatttttctccattaccctgccattggtttcaccaaccctgttctttgttgtggtaaccagtgtcattcaatccatgcaagtctttgatgttatctatatgatggaggatgttcgtagtcctgcctatgataagacagtatctctggtttatctgttttacaataattcctttaaatattcggataagggctatggctccaccattgtcatgttgttgttattgattattcttgtcattactttcgttcagatgaaggtacagaaaaaatgggtgcattaccgttaaggaggttcatgtgaaacaatcagcttttaaatcaacaatctggatgcatgccttcttgattttagtggcaatgggcatgctgatcccatttgtttggatggtgttgacgtcttttaaaacggtaaccgaatccactcagatgaatcctttccactttttaccaagtaactggatggtgagcaattatacggaggctattcggactaataattttccgatactctatctgaacaccattttgatgatgttatggcgtatctttagctcggttatgttttcagctatggcagcttatgcctttgctcgactggagtttcctgggcggaatttcttgtttggtctggtcctctttcaaatgatggtgccacctcagttattcgtcattcctcagtatttgatgattgaccaacttggtatgcgcaatacgatttttgctctggtattcccaggaattgtcagtgcctttgggacattcttgctccgtcaatttttcatggggcttccaaaagaattggaggagtctgcgaaattggatggttgtaatatcgggcagaccttctttaaggtcatgttgccattggccaagtctggcttgattgccttagcgatttttacggctttgtttgctttcaaggatttgctgtggccattgattatcaactcagaggctgacaaggctaccctatctagcgcactttctaagattcagggagcttacgctgttaactatcctcagctcatggctgcaagtgttttggctatttggccgatgttggtactgtatgtgatattccagaagcagttcatccaagggattgcgacatctggtggaaaattataggaggctacaatgggaattatctttcatgaaaagacaaaggaattccatctttacaatgagtttattagctatgtgttgacggtcttgcctaatggtcatattggtagtttgtattatggaaagcgtgtaacagaaacagcttcttatcagtatgtacgtgaagatgagtatcgtgctttgacttcctttgtagaagacgatgaccgtttcttttcgctccaatatgccaatcctgaatttgcttgttatggtacaacggactatttttctccgacttttgagttggtgcagaaggatggtagcagtctatcgcactttgtgtatcaaggtcatgcgatttatgctgggcgatcggctttgaagggtcttcctcatctctatctggatgaggagggacaggcagatagtttggatatttatttgttggatgaagattcgcagacccggctggtcttgtcttatacgatttttcgagattatccagcggtgactcgctctgctcgttttgaacaactcggagaaaaatctgtctgtttgaaccgtgccttgagtatgacactttgtctgcctgatatggactatgattggttgcatttggatggggcttgggggcgtgagcggcatctgcaactatcgcctcttcatcaaggttgtcagtctatttacagtctcaaaggggctagtagtgcggagcacaatccctttatggctttgaaacgcccaactgcggatgagcaacagggagaggtactaggcttctcgctcgtctatagcggaaactttttggcgcaggtggatgtgagttctttccaaaaaacaagagtgagtatgggaatccatcctgagcgtttttcttggacattagataagggagaagagttccagacgcctgaggttgttatggtttatagcgagcatggtttgaatggcatgagccaaacctatcaccgcctcttccaaaaacatctggtacgtggctattggcgtgatagagaacgacctgttctcttgaataactgggaagccatgagttttgattttgatgaggaaacaattctttccttggccaaagaggctgcaggtcttggtgttgaactctttgtcatggatgatggttggtttggcaagcgaaaccatgaccgagcaggcttgggagattggacggtcaaccgagagaaattaccaagtggcttgacagggattattgaccaagttcatgctatgggaatgaaatttggactttggatcgaacctgaaatggtcaatagggacagcgagctttaccgagcgcatccagactggattttccatcatcctcagcatagtcaatcgcacggacgccaccaatatacgctggatttgtcgagggaggatgtttatcaaaatattcatgaccaactccatcggctgttggctgagcatgatattgattatatcaagtgggacatgaatcgctatatgacagaggtctttacatgtacacgggaggcggatcgacaaggtgagaccttccatcgctatattctcaatctctaccgtttatatgatagcctgatagcagcttttccgacagtcttattcgaatcttgttcaagtggtggagctagatttgatccagggatgctctactatgcaccgcaaacctgggtcagcgatgacacggacgccatggaacgcttgaaaatccaatatggaacgagcatggtctatcctttgaatagtatgggttgccatgtgtcagctagtccaaatcagcagttggggcgtgctactccactaaacacacgtgccaatgttgcattctttggaagttttggctatgaattggatttgtttgagtgtagccaagaagagttggaagagatgaaagagcagattgccttttacaagactcaccgtaagattttccaacagggtattttcactcgtctgaaaagtccattcgatggagaaataacggcttggcaggtccaatcctcggatggtcagcaagtcatcgtgggttattatcgtcggttgacaacggctaatctctcctatcaacgcttgtatttgcagggattggaagaggaagcggtctatcaccttgatggagaagtttatactggtagccaattaatgcatacaggtttgtcgattcgacatggggaccatgttggagacaataaggactttacttcttgtttgatggtccttcagaaacaacagtagcatccctattcctaggcccagctatcggctgggtctattttatgcagaaagtacatcaataagagcaagacctctacttatactcttcgaaaatcaaaattatccgttgtcaacttgccttgatgaactccagttctatcttcggcttcgtttcctaggctacttttgattttcattgagtattagatataagaattcttgaaaaacgggttgcaatgtgagaaaatgagagaataattcttcaatcaattagtgaggggaagggagataatgaatgaagaaatatgcttttcgtgaagggatgcgcgatgccattcccactgtattgggctatgccagtattggtctagcctgcggagtcgtatcggttaattcgggcatttctactgtggagatggggctgatgagcctattaatctatgccgggagtgctcaatttgtcatgtgtgccatgatttttgcaggtgcgcctttgttatccattgcagtaaccgttttctttgtcaacctgcgtaattttctgatgtgcttgcatgcgacaactatttttcaaggaaatcgtttagggtcgaatatcttgataggatcctttgtgacggatgaatcctatgcagttcttttgcgtaagcagattgagcatcataccattactccagaatggatgtacggaaataattttgcaagctatgcctcttgggttacattcacgactctcggcaatctgattggtggtctcattccaaatcctgagcagtttggattggactttgccttggttgctatgtttgtcggtatttttgcaggtcagttagaggctatggttcggaccattccgctgaaaaaaattggcttaattctgctggcagtcggtctggcctatatcggtctgtctatgatggtgtcgtcctatgtggcagtgctcttggcgacactactaggttgctttgtgggggtgatgattgatgataaaaactaacattttactgattattctaatggcggccctggtgacctgggtgccacgcgtcctgccttttgtcctgacgcaaaataaatctctccctccaaagttggtgaaattcctcagctttttgccaatcactatcatttttgcattgaccctctccagtattatggatgagaaagttggctccttgccaagttttctccctgtggaaagcttagctattcttccgacattttttgtggttttgaaaacaaaaaatatccttttagcagtcttggttggcgttgttacaaccgcgttattacgtttgatattttaggaggtttttatggtaaaagaaaatgccaaaggtgtcggactttgtttccttttggctttggtgggtcagtggttaggtcatttatttccacttgtaggtgggcctgtttttgcccttctaattgggatgggtctgtatccctatttttcaagtaaaaatgcatttcagtcaggcttaacctttacttccaagaaaattttacagtatgctgtgatttgtttgggatttggattaaacttatcagcggtcttggcagttgggcgtcaatctcttccaattattctttcgaccattagttttgctttgattttggcatttctgatgtggaaaatcttgcccatttcatctcatctggcaaccttgattggcgtaggtacctctatctgtggaggctctgccattgcggcgactgctcccattattcaggcagatgatgaggatgtggcacaagcaatctcggtcatctttctcttcaatgtcttggcggctttggtctttcctagtctggcaacttggcttgggttttcgactgattcgggtcaggcctttgggatgttcgccggaacggcggtcaatgacacctcctctgtgacagcagcggcttcgacttgggatagcttatatggtctaggcagtcagaccttagatacagcagtgacggttaagctaacacgaactttagccattatcccgattacaacggttttagcaatttggcaaacccgaggaaagggtctcaaggcagacaagaagtccctcttggcaggttttccgacctttatcttgtattttatcttagctagtctaatcacaacgatagcgggtggatttggtataggggcagattggtttgctccgttgaagtccctctctaaatttttcatttgtatggctatggtggcgattggtttgcggaccaatgtgtttgccttggtgaaaaatggcagagcggctctcatggttggtctggtttgctggctgggagtgacggtgttgacactggtctggcaagcgattttggggatttggtaagagaaatgtgagtgggaaagacatcatttcctatttcaaacaatttttgagaagtaaatcgcagtgccgcagggctttttgtcgttcggtttttagtaccgttgaacaacttaaaactagttagttttgtttaaaatgtaattgaattgtctttttaagtaggctgtttacacgatatttgtcttcctttatataaatatgatagattttcagtaaatttttcaaaaaaacctcaaaaataacagattttttcttgtatctttgaggcataaggagtataatggtgacggtattcaagtagaaattttatatactctggatgaaaacattctgtctactttaaaataaataatctactgggtatccttctgctaagtttttaaagcaggaggtgtgtttttgtacatggtgttacaggaaccagaaatgatggcattcgccagtaaaatataggaggatatcatgtcttataaagatatgttcagaaaagaacaacgtttttcttttcgtaaatttagctttggtctagcttcggcagtcattgcaaacgttattttgggaggagcaatcgcaaacagccctgttgttcatgctaacacagtgacagaagcagagacagctgtagcaccagctaaccaagaccttggaaatgagactaaaacggaagaagaacccaaggaaccaatcgaagcagttcgcacggacatggaaaaccgtgcagctgaaatcttgccggaggcgctgaatgctagtgtaacaaaccaagcaccagttattccgactattggagatcttcctaaagatgcgagtggtcagaatgttcatggtaaggcaacggataataagatttatcgtgttgtatacgtttttggtaatgtagcagggactacggagacagaagatggtaaacaaaatgttgctccaacatttaacagaaatgatgcaactaaaacttttccaatcacagatccagatagcgacattcaaactatttcatacgaagttccagctgatattgcaagctataccttggatgatccaaactcaattgttactaatggcacctcacctggtccagtatcttacttagatggtccaaatgggtcagccactctcacacaagatggttatctaacaggaagtttcccttggggagcaggagacctagctggtcgtcggattaaagtgacggatgccactggtaatactactaagagtaatccgttctatatggttgcatatacagtcaagccagtagatgataaacctctagcagtatcaaactcttctgagctgacggaacaggctatttttgataagttggttgtcgataagtctgctaaaacaacttcaaatagcgctcttgtaattgattctagcaactacaaacattcaattgcaggttatcgtaccgtaaattctgatggcacaaaaacagaaacagtagagaaaacaaatctatctgatttcccaactgaaggtaaatacgaagttcgagtaaaaacaaccaatgtttacggtcaaactatctacaactggattcctgtaaatgcctataagttggacacagcgaaggatgctgaaattcggaagtatacagacaaccaagccccaattcatgctataatgcaaattggtcaagctggagaaaaggcagcagttatattgaaggatattccatccgatttcagtattgaaaacttcaatttgaaagatggtgtagcagatgagcttgctaaacgtaacttggaatttgtaagaaatgatgcagtggcgacaactgatactgatggagatggcgccaaagaaggaattgttggatatattcaaccaaaaactggcggtgcaaacagtggggtagccacttatacaggatcaaataatcttacttatggcttcacttacaaagctgttgagacaaaagataaggcgaatgccacagaggctaaaactctcgaattagattacaccatcttattcatagatactaaagcaccagtcatgacacctaaatcagagtacatccgttttgttggtgaagagtatacggttagcgtcccaggtacggataacgccttccttaataccggcaaactaaatggaactctctcaattttgaaagatggagagtcaggttctcttgtatcatcagacttaggtacaaacactaagattacttcagaactggatcctacgggagcaactgcaaaccaaggagatgacggtcaatcttcaactaagtttaacgttaagattacaggtaccggacctgctacagaaggtaccggcacttataagcttcgtgttggagaagataactatccttttggtccagaggggaaacttgttgatggaaataaaccagaaaatgtaggtttgacatctgtaaaagttaccttcgtaaaacatgctacggtgtcaacaccagtttctgttgaaaatccagctaacttaacgccagaagaaaaagccgcagttattgctcaaatcaagaaagacaacgcagacaacgaaagattgaagggcttgccagattcagcatttacagttaactcagatggtactgtgtcagttgactacagtgccggtggtgtcaatgttgatggtgcgacagacattattaagaatgctaccacaaacttggcagatacacggaatgaagcaaaagcagaaatcgacacaaaattagctgaacataaaaaagctatcgaagcaaaacgggatgaagcgttttctaaaattgatgatgacatttccttgagagcagaacagagacaggctgctaaggatgccgttgctgcagctgctggggatgctttgaaagaattagacaacaaggcgacagaagcaaaagaaaaaattgataaagctacgacggcctcagaaatcaatgatgctaagactaatggtgagattaatctggacagtgcagaagcagtaggcgaaaaagctattaaccaggcgaaggaaaaagaactggcaaaagcagaagttgaaaacaaagcattcgaggcattggaaaaagttaacaataatccaaacttgttagaagaagagaaaaaagcatactttgatgatattaaagaatctaaagaagttgcagttgagaaaatcaataatgctgaaaatactgctgaaattacggcagcaattgacgaagcggaaattgcatacaatgaagatgttattaacgcagcccaacttgatgctttgaataagcttgaaaaagatagcgaagaaactaaggcagctattgatgctaatccaaacttaactccggaagagaaagcgaaagctattgctaaggtagaagagcttgttaataatgctgaatctgacattttgtcgaagcctaccccagaaacagttcaagcagtggaggataaggctgacaaagatcttgccaaagtagaacttcaagcagcagcagacgatgcgaagaaaggcattgaagcaaatccgaatttgactccagaagagaaagatgtagctaagaaggcagtagaagacgcggttaaggtggcgacagacgctattgataaggcgtcaactccaaccgaagttgacacagcgacaagcgatggagtgaaggctattgatgcagaagagtttaaagctactcagaaagatgctaagaacaagattgccaaagaagcagaatcagctaagaaagcgattgacgacaatccaaacttgactccagatgagaaggaatcagctaagaatgcagtggaagaggcggctaaggtagcaacagccgctattgataaagcatcaactccagatgcagttcaagtagaagaggacaaaggtgtagcagctatcaatttgattactgccaaggcagatgctaaaggtgtcattgctgctaagttggcagatgaaatcaagaagctcgaagataagcaagcagaagcagaaaaagctatcgatgcgtcaactatgactaatgaggagaaagcaatcgctaagaaggctcttcaagatgttgtagataaaggaaaagcagagcttgaagacgcagctagggtagcaacaaatgagattcatgaagctactactacagaaaaagcgaaagcggcggaacttgctggcgaaaagagcttgacagacacaggtaaagaagctagagatgcagttgaattggctaaggataaagaattagctaaggaagcaatccgaacagaagaagaagaagctactaaaatagtagagaaacttgcagaagatacgcgcaaagctatcgaggacaatccaaacttgtcagatgaagataagcaagcggaaattaaaaagctaactgacgctgtggcaaaaactttagcaaccattcgtgacaatgcagataaggctacgcaagaagcagaaaaagctcaagccctagcagatcttgaaaaagctaaagaaacacagaaaattgcagataaagctgcgattgataggttgactatacttgtgaaagatggtgagcttgaagctactaaacaagatgctaagaacaagattgctaaagatgcagccgctgctaaagaagcaattggctccaatccaaacttgacagacgcagagaagaaaaccttcaccgatgcggtagatgcagaagtagccaaagctaacgacgcaatttcagctgcaaccagcccagcagatgttcaaaaagaagaggatgcaggtgttgcagccattgcagaagatgttcttgacgcagctaaacaagatgctaagaataagattgctaaagaatccgacgctgctaagtcagccattgacgcgaatccaaacttgacagatgcagagaaggaatcagctaagaaagcagttgatgctgatgctaaagctgcgacagatgcaattgatgcttcaacaagtccagtcgaagcgcaatcggcagaggacaaaggcgtaggttcaatcgcccaagatgttcttgacgcagcgaaacaagatgctaagaacaagattgccaaagaagttgccgcagctaaagaagcaattgatgccaatccgaacttatcagatgcagagaaggaagcttctaagaaagcggtagatgcagatgctaaagctgcgacagatgcaattgatgcttcaacaagtccagtcgaagcgcaatcggcagaggacaaaggcgtaggttcaatcgcccaagatgttcttgacgcagcgaaacaagatgctaagaataagattgctaaagaatccgacgctgctaagtcagccattgacgcgaatccaaacttgacagatgcagagaaggaatcagctaagaaagcggtagatgcagatgctaaagctgcgacagatgcaattgatgcttcaacaagtccagtcgaagcgcaatcggcagaggacaaaggcgtaggcgccatcgccaaagacattcttgatgccgcgaaacaagatgctaagaacaagattgctaaagaggcagaatccgctaagtcagtcattgactccaatccgaacttgacagatgcagctaaggaagcggctaaatctgaaattgataaagctgttgaggaagcgattgttttaatcaatggtgttagaacttatcaagagttggaaaaaatcaaacttccaatggcagctctaattaaaccagctgcgaaagtaacaccagtggttgatccaaataacttgactgaaaaagaaattgctcgtatcaaggcattccttaaagagaacaataacctcccataaggaacagagattaatgtttctaaagatgcttcagtgacaattaaatatccagatggaactattgatttgctatcaccagtagaagttgtgaagcaggcagataaaactgctcctacggtcgcaaatgatggcaaaggtaatattgtgattgtaccgtctgaaaaagctgttgagcttgttgtttcatacgtagataacaatggtaagtcgcaaactgtagttgttacgaaaggtacggatggtttatggacagcaagtaatacagtggtgattgtggaccctgtgactgggcaagtaatcgttccaggttctgttattaagccaggtacagttgttacagcatactctaaagacgaggttggaaatagttctgattcagcagaagctgaagttgtagcagtagacgaaaataattctgcagcaggagtgaaagttaaatcagttactacaaatgctaataatgttgagaagaaagctaagcaattaccgaatactggtgaggaagcaaattcagcaacttcactcggattagtagctcttggactcggattagcacttcttgcagcaaagagaagaagagacgaagaagcttaagataagctcttcctcagaactcttttggaagccgcaattttcctagaagatagtagtatgatactctttcatagcaaggaaattccctcgctatgattggtaggtatcagttattatctatcgaacccccaaaatccaaagtcattcgactttggatttttttgatacgacatgctcgtcatacctaaaaaacagccttctcttgcgagaggctgtttttcatgcttttaatctaaaagtctgcggagcttttttcaataaaatccagtaaccgatgctaacataggcaatcatagctagggaaaccagcaggatataggtgtggctacctacattgattcgggtgttgagataggccacccagtagagagcaccgctaagaaatttatagaggggattgaccacatccatgtcattggtaaaaggctggaggatatagtagataaagagatcgtggaaggaaaagagagcggtcagactgatgaggagcagggcagttagtagaatggtttccaaactaaaggcaaaccgccccagcaccatgatagccaaaaagaggctggtcgcaaagatgagattgagcttgcaggtctgcaaaaatcggtagttaaaaccagcgataatagtcttggcttctcgatagaagggatagtgaagcatggaaatatcgcagttaacaaagaccatctgagccaccaccttgcccgacgaagctacgtacataatcatgaaggaaagcggtaggaattggagcaagtaggcttccgtaaaggtaaacggatctaaaaagtaacgaatcccctccagggctgccagaatcacgactactgccaagacccagttctgcaccttcttatagaggacttttttgtagcggtcaaatagcagagcatttaagtaggtcatgccagacaggtgggacaggtcctttcctgttttcgcattgagttttgcctgcatctgcaaaccctggcgagtgtattcatttcccttggtcatctcaaaaagtttcttatccatttgcaaggactcgtccatacagtaggaaagatagtctaggtggttggtttgttgcttcaaataaccatagctaaaccaaatcagaaatggttggacaagcaggatagggactagcatgcctgaggagagctgattacggaagacaatagccaaaacatataaaacaaaaacaaacgcgatccatagccaagcatgccacgaattgcgacgggaaaagatacgacgttcaaagagcagacgattgagggcatggccagctagatgacctgccagcactgtcatcaaaccaataggaaaaactaaccactccttggttatcatgcaaaaaatggttgaggctggcaggtagtaaatagtggtcaggataggctcgataaaaagttggctttgaagaaagctggattgtgacaggctgaaattctgcataaattctcgatctgctttagagataacagggtctaagctcttccccaaacgatagcttagtccgacaaacaaaagccagaacataaagccaaggagccaagtgtttgggagaattttccaaaaggtcagctccccattgactagcatattcatccagaaagaagcatggtagaaatgaaagagcaaccagaagcccttgatcaggaagcgactggggatggataagatgtgcaggaccaaaaagagactagacttaaagctgtaagacttgaaaatactctctggaatgcactttcccacaagcggcagtttccgaagatagtagaagaatccattgactgaccgatggaggttatatttttcctgataccaagaataacgtaatattgttttcataggtttctcctaatctgctgtcagcaaggcaactacttcctgttcgaagtcaggatcatggagtttgtcgctcggaactgcttgcaattcttggtgatggagcaaaacaatctcgtcacagaggtcttgagccagttgtaagatatgggttgaaaagataataacggaatcctttttagcctcccgaatcagctgtttgaactcgtgggcagccacagggtcaaaggaagtcagcggctcatctaagagaaggacaggtggctggacaatcagggacaggagtagctggaccttgttctgcataccatgggaaaaatccttgagcagacggtgctggtcttcttctccaataccgaccaagtttagccattcttctggactgcgaggagatttgagtttatccttatgaatgtccatatagaagcggacaaactcataggctgtcataaaggcaggtagttgtggataggtctgggtaaagccgatgtccgtattatcgtagtcaagagtttcttcgcctttcacaaactgaatcgagccattatccaaggtcagattacgggcaatgcagttaaacaaggttgtcttaccagccccgttccgtcctagcaagccgtaaatcttgccttgttcaaattgaaaactggcatcctccagaatactcttgtgatcaaattttttagaaatagaagacagtttcagttgcatagccaatctcctttgttatattgttatggttttatcatacaataaaaaacaaaaaaattcaagcagtttttgcttgaatttttcagtcattaaataattagtagtgtactactcaaagaaaatcgaactcagactagctccaaaggttcggggaacctttggaggttggagataaggcgaacaaagttcgctacaaaaaggttcggggaacctttggaggttggagataggggaacaaagttcgtgccattagatgtagatagaacgctgtaccttttattttcgtgtagcaggctgtaaagctccactggagctttacactcatcaaatcaagtcaacaacgtctgagtttgatttatgaagagtaggaactaccagccacccagccagtcgcaaggcagtaggtaatgttaaagccaccggtgtgggcgttgatgtccaagacctcaccagcaaagtggagaccaggcaccttcttgctttctaaggttttgggattgatttccttgaggtcaacgcctcccttggtcacaaaggacttggccagggacatcttgcctgtaatcttgataggtaagactttgaggagggtgaccagttcagtcaggtctttttgggaaacttgcttgaccttgctatcgtagttttcagcgaaaaagtctgctagacggtctggcatgagttcagaaagggtattcttaacggatttttccctgttcttttctaaatgttcaaacaggtcttggtcagaatgggtcggcaatacatcgagaaatgcggtttcgccgcctttgacaaaactggacaagcgaagagcagcgggtcccgacaggccaaagtgggtaaagagcaggtcgtgggtgatgacgtgcttgccgtaggtcagggtgacgtcgtccagggaaattccttggagcttcttgtgggggaagtcggtcaggacggggctttcagcggcttcaatctccgtgacttccagcttgaagtggcgggcaatgtcgtgtccaaaaccagtcgatccggtggaaggataggtcttgccaccggtggtgacaatcagctggggagctgtaaagacttcctcgctggtcttgacatggaagaggtcatccatcttgcggacggacaccacctcagttcctgtacggatgtccacgccattttccaacattttcatctccaggcacttgataatggtctgggagcggtcggtggttggaaagacacggccgtggtcctccaccttgagcttgaccccgttttcctgaaagaaattcatgatgtcatggttgtcaaactgagaaaagacgctgtacagaaagcggccattgccaggaatgcctgccagcaagtcttccagtgtgccgttgttggtcacattgcaacgtccgccgcctgtgccagatagtttcttgcccaaacgcttgtttttttcgagaagcagggtcttcttgccataaaaactagaagaaatggcggccatcatgccagcaggccccgctccgataataatggtatctactgtattcatgcctttattgtatcatattttcatcaagaaagtagtttgagtctttgctatgatttgtggagtttttccttgagattgcggaagaccattgacgggttaggggagtatacttaaactaagggaaattagtttttatcaggagcctgtatgtacaagcaaagtaattttgtggaaactgcattgtgaaaccaggttctaacaactccgtctgtagcatgaaagaaagtaggtagaagaatggtaactgagcaaagagagtatcgttttccagaaggttttttgtggggatcctccacttcagggcctcaaagtgaaggaagtgtagctggtgatggaaaggggtggaataactgggattactggtacagtcaggaacctgagctctttcaccagcaaataggaccggaacaaacatcgactttctatgaacatttccagtcagatttggatttgttggtggaaacatgtcatagtatttttcgcacctctatacagtggtcacgtctgattccggaagggataggcgaggtcaatccgcaagctgtggagttttatagggctgtatttgcaggtattcgagagcgtgggataaagcttttggtcaatctttatcatttcgatttgccttatgtcttacaggaaaaagggggctgggaaaataaggagattgtctgggcctatgaggcttatgctcgccagtgtttcagcctctttggggatttggtggatcattggattacctttaatgaacccattgttccagtagaatgtggctatctaggaagctatcattatccttgcaaggtggatgcaaaggcagctgtggtcgtagcgtatcatacgcaattagccagttctttggcagttcgggcctgtcaccaactacacccagaccacaaaatttccattgttctcaatcttactcctgcctatccaagaagtcagagtccagaagatttacaggcagcacggattgctgagctatttcaaacgagaagctttttggatccatccgttttgggacaatacccgagggagctggttgacattcttgaaaaacacggtttacgtccagaaaccacagaggaggaattgaccattatcaaagaaaatagggttgacttcctgggggtgaattattaccagcccctgcgcgtgcaggctccttcagaagatggatggaacggagagcctactttcctatcccaatatttccagccttatgataagcctgacaagaaaatcaatccccctagaggctgggaaatttacgaagaagggctgtacgatattgctaaaaatatccaggaaaactatggaaatatcgaatggttggtaactgagaacggcatgggagtcgaaggggagggtgtttttgaagaaaatggcatgattcaggatgactatcggattcacttcatggaagaccatttgattcagctccatcgaggtattgatgaaggggcgaactgtaagggctatatggtctggacctttattgactgctggtcttggttaaatacctataagaaccgatacggtttggtctcgcttgaccttcaaactcagaagcgtactgtcaaaaaatctggatattggttcaagcaagtgagtgctaaaaatggttttattagatagaatgtatatttcgtttctgcataacattgcattgagataagatgcttttgaggtttgtgattattcactaatgcttggtaaggaaattcccctagatttgacagggatagggttctgtggtaatattttaatgatacaaactatgagaaatgtaagtaccgaggatattatgggaatcgaaaaaacagtcagtgagttagctgaaattttaggagtgagccggcaggctatgaataatcgtgtcaaatcacttcctgaagaatttgtagataaaaatgacaagggtgtgaccgttgtaaatcgtgctggcttgattaagttggaggaaatctacaaaacaaccatttttgaagatgagccgattagtgatgaagtcaagcatcgtgaattgatggaaattttagttgacgagaaaaatgctgaaatcattcgcttatatagtcaattaaaagctaaagataagcaacttgccgaaaaagatgaacaactcaaggttaaagatgtgcagattgctgagaaggataaacagttggatcagcaacagcaattgacactaaaagctatggccgataaggaagttctcaagttggaattggacgaagttaaagcacaggcagaagaagtgcaagctaaaggcttctttgcacgtttatttgggaaataaaaaggtccgggggacctttttatcatgagcttgaaaacaagagagcgaataaaggtccgggggagtgaaacagcctggggatagactgtttcagcccgagctaaaaactggaaaatgatatgtgatataaaaagattggtgggaaccaatcttttttagtttaagtagtgagcacaattgaatttttatttttcattatattaattgggctcaaagactctagaaatcagaaatgaaaagggatacaattaagacaaggaggaaaatatggttgataatcgtaccatggcgattctgatggaattgtttgcgactcgaaaagaaagtttgtacgaacttagtattcaaacaggaattgaaaaggagcagctacattctaatttggaactagtcaatcaattgttgcaagaacattccttcccgcagatacaatacaaagatagcgagtttgttatttctacggagctttacaatcaaaaagaaagtgtattttcgctctttcgcaatcgccagatctatctttcgcaagaagaaagacagcttcttatctatctttatacctttatccgaaaagaatttgtatcaaacgttcactaccaagaattattgagtgtgagccgtaacacaacattgacggatattaagaatgtaaaggaactttgcttggactttcaagtacgattggaatatacgagggcgaaaggctatcatctaattggtcgagaagaagataaacatcgcttggcgctttatgcactcagtaattgtttgcagtcttcgattggtgtgtgggctttggattatattcttaaatcttggggtgaggaaaatcctattgaagaattgaaaatagtgagtcaacaagcttgcaattattataaagtctcagctttagaagagagattggatgaatatttgtattttttgatatttttatttatccgtcaggcgcgtgttggcaaccgtattaactggaattttgaaggaaagggagggtttgtaaaagattttctgcaacgcctttggaaattattacgtttaaaaagtactagcacattagaattaaatgctgcgacacaagagtatctgtcacatttactgcaaggatgcttagaaggtgagagcggagaaaaggatgatctattttaccacttgactgtagaaatagtggaagagatggaacgtttgtccttaattacttttgaacatcgctcggaaatgattgaaggtttgcaacgtcacctaattcctgcttactaccgtttaacatctcgtttggtaaatgtcaattcatatactgaaaccatcaaagaagagcatgccgacttgttctatcttgtaaaaaaagctttgcgacctttggaagagcatctaggttttactataccagatagtgaggtatcttattttgtcatccactttggtggctacatcgaagcaggtcaacaacgttcatatcgttatcgggccttggttgtttgcccaaatggagtgagctcttcgctgattgtaaaagaaaatctacggcaactatttcctaatatctattttgccgatacccattccttacaggattggaagatgctagacatgacagactatgacatggtatttggaactatcaagctgaatatagagctaccatttttcttggtatcccagctgatgacctctaatcataaaaaagaattatttcatttggttaatcagcatttcccaaatgcggcttattttccgattgagattgagcagttattatcacttgttgggaaacatgcaaccattcatcaggagcaggctttaaaatatgaattggtgcagtttctcaatcaacgctcccatgagcaaaggggaaggagtcctatgttagaagaattgattacaaaagagacctttcaatggtctgaggaagttttagactggcaaaaagcagttgccctggctgcacgacctctggtagataaaggagctatagaaactcgatatattgatgctatgatagcgaaggtagaagagtttggtccttttattgacctaggtaaaggaattgcgattccacatgcacgaccagaagatggggttaatgaggtagggatgtcaatgttggtattggataagccagtttatctattggatgaccctagtcatgaaattcggctgttcatttgtattgcagccgtggataatcaaacccatctcagagcactctcgcatttgacaaaaattttgcgagaagaagaaaatattcaacaacttgtcggcaccaaagaattcgccgacgtacaacatttattaaaggaggaacagtaatatgttacgaattggaacagcctgtggttcaggtttaggctctagctttatggttcaaatgaatattgaatccattttgcgagatttaggtgtatcagatgttcatgtggagcattatgatctaggtggtgccaatccgagtgaagcagatgtgtggattgtcggacgtgacctggctgattctgcaactcatttaggagatgttcgaatattgaatagtattattgatatgaatgagttgagggaacttgtcacggctatctgccaagaaaaaggtttggtttaaatcgtatacacaggggatgacccgcaaagataaaattataaaggagacagaaaatgatattggattttctcattgatattgctaaaactccggcaattctggttgctctcattgctattctaggtttagccttacagaaaaagcctgcagcagatttagttaaggggggcttgaaaacttttgttggttttattgttgttggtggcggagcgaatattattgttggctcgcttgagccatttggtcaaatgtttgaacaagctttcaacttgaaaggggttgttccaaataatgaagctattgtagcgatggctttggataagtatggaactgctacatccttgattatgttgcttggaatggtcttcaatattgctattgcccgctttacacgctttaaatatattttcttgacaggacaccacacactatatatggcctgtatgattgcagttatcatgagtgttgcaggattcacttctgtcggcctaattgtgatgggtgggttggctttaggtctgattatgacactcttcccagccttcgttcaaaaatacatgattcaattgacaggaaatgatcatgtcgccctaggtcacttcagtgcacttggttactggttgagtggtgtagtaggcggtttggtcggtgataagtctaagtctactgaggatattaatttccctaaaggtttggcattcttgcgtgattcaactgtcagcattgccatttctatgtccttgatttacatgattgtggctttgtttgcaggcggtgattatattaaggaaaaccttagtggtggtactaacagcatgatttacgccttgaccctaggtggaacttttgcagcaggtgtttttgttatcttatctggtgtacgcttaattttagcggaaattgttccagccttcaaaggaatttcagagaagttggttccgaattccaaaccagccctagactgtccagttgtttatccttatgcaccaaacgccgtgttgattggctttatctctagttttgcaggtggtattgtcagcatgattattcttgccttgactggcggtgtcgttatccttccaggtgtcgtaccacacttcttctgtggagcaactgcaggggtcatgggaaatgcgtcaggtggtgttcgtggcgcagtttgtggtgcttttatgcaaggggttctcattagtttcttacctgtattcttacttcctgttttgggagaccttggttttgctggttcaactttctcagatgcagactttggtctttctggtattttcctgggagtgctagctaagaatggcggtatcctcacagtttcggttggtatctttgctgtcttggctttgatgcttggattgtcattggtgaaaaaagaacagaaagaaggataatatgactagtggtacagctgatttgaaacgatttgccaaagaaattcgctaccataccttggcgactttgaatcaattaggattcggtcattatggtggtagcttatcaatcgtagaagtgttggctgctctatatggagaaattctggacattcgtgtccagaatttctcttctaaggagcgggatcactttattctgtctaagggacatgcaggtccagcactttatagtacgttgtatttgaaaggcttctttgatagagattttctcttgtcgctaaatcaaaatggaacacatttgccttcacaccctgaccgaaacttaacgccaggggtggatatgacaacgggttcgttggggcaagggatgagtgtcgcgacaggtgttgcttatggtaagaagatagaacagtcaccgtactatacctatactctggtaggggacggggaattgaatgaaggtcaatgctgggaagcagctcagtttgcagcccaccacgaactatcgaaaatgattctgtttgtggatgacaataaaaaacaactagacggtcgtacccatgatatttgccaaacctttgattttgttgaaaaatttcaggcttttggttgggaatcagtgcgtgtgaatggtgccgatatagatgctattataaatgctattctaacaatgaagtcaagtaagtctcctcaaccaaaatgtatcgttcttgatactactaaggggcagggagttaccttcttagaagaattagaaagcaatcaccatttgcgtttgtcgggtcaattacgggaagatttagagcaagtaacacttgttttagcgagagagttggaggtgacggaatgagacagacaaaggagatgcgactggtttatagtgattttctagctcaggtagggcaggaagacacaaccatagcagctattgaagcagatttatccagttcaatggctaccaacaaattgtcctctgttctggggggacgctatgtcaatgtaggtatcatggagcaggaaatggtaggggtagcagctggattatctcttctaggatacaagccatacattcataccttcggaccatttgctagtcgtagagtctatgatcaggtgtttatctctctagcttatgcccagctcaatgccacgattgtagggtcggatgcgggggtatcagcggagatgaatggtgggactcacatgccgtttgaggagctgggcttaatgcggctcattccaaaagcgcgtgtttatgaggtcagtgacgatgtcctgtttcaagctgttcttaaagaaaccatcaaggtagacgggttgaagtacattcgtaccattcggaaagcgccaacgcctatttatcaaggtggagaagattttagcaaaggctactgtgtccttaggcaaggggaggatatgaccttgcttgcgagtggtattatggtagagcaggcattaaaggcggcggatcagttagaggctcaaggagtatctgttcaagtcattgatctttttcgtatcaaaccaattcatgaagacatatcagctctattatcaggaaggccagtattaactgtagaaaatcataatcgaattggtggcctaggtagtagcatttgtgaattaatggctacagatttaacgaccccagtacatcgaattggtattgaggaatcttttggtcaagttgggcaacaagcttacttaatggatgtatatggtttgacagcagaatatattgttaaacaagcacaattaatgttacaacaatagtgagatagtgattcgtattttatgtagcctttcgatttactttggcttggaaataggaaagcaaatcaaatgtaagaaatcaagctccacttaggaacttgattttttctatacttcattcattgctttcacaatcttccatccttgatgaaggcttgcaattcttgctagaatatgggacactagaatcatgaaaaagatacaacgtgaatttcaaaaaatatattacaacttagacaagattctcttgctcttctttaccctgtttacctttatggaatttgtttggataccgctcaattcatggatttctgagggactcttagctatgacagggcatgcctacctttcaccgacgaatttgttgtcggtgtttgctgaaaatctgctcgtgacaggcttgtttattctcctcttttttgtcaacattgccattgcctatctagaattagctctattgttcacaggggtttggcaactgttggatgaaaaagtcaagcacctcaccgactatttacgggatgtacgagatagtatggtggcgattatccgtcacagtagcctaccaaaggttctatttctgctcttttactcagttattcttcttccatttttacgccgagtattaaatatctattattttaataaaatcgtagtgccccaatttatcgtagattacctatccaacacagtctggctaggaatattgattttgattttcctcctcttgttcttctggcttgcggcacgcttcatgtacgctctgccaaacatttattttgaacacaggggtgtgaaggagtctatcgcttattcttgggagaagaccagaggcagaaagcagatcggttcattgttccgtctaatttggttggttacttttccagttctcctatttacaggagtaggaggactattctatcttgtgcaactgttagcagagcattttgtaccaagtgcttcttactggctggcagttgtctgttacgcacttctaaaattagcctactacggagtagttgcactcttcatgatgggatttgtcagcctcctaacaggaaaacaactaccaatctaccgccgtaaacgcctccgtcatcaccttcgactagccattttgctcgtatctggtctggtgttcggtacccaaggagcgcttgccctctactttccctttgacactctgccggttaccatttctcaccgaggtgtcgatgacggcaatgctgtccagaactctatcgaggccctagagaaaacctctcagctcaagccagattatattgagatggatgttcaggagacgaaggatggtcagtttattgtcatgcatgatacggatttattggctttgacgggcaatcccggaggtacacatgactatactcttgcagagttgacagggatgactgcatcagaaaacggcatggcagctccagttccttcttttgatgaatatcttgaaaaagcggatgagctgggacagaaattattggtagaaattaaagtgaccaaggcagattcgccaaaactcacccagaatttcttaaaaaaatacggtcaacgtttgattgccaaaggacaccagatgcaatcattagattaccgtactattatcgaaataaagcagtatagcgagaaattagtatccttctttattcttccgttcaattcaatttatccgacgacggttgctgacggctatactatggagtatacctcgctggatcaaaattttatgaccaagtcttggattcgagggaagtcggtttatgcttggacaccgaatgaagaagagagtatgaccaagatgttgctgctacaagtggacggtatcatcactgacaacatgaccgacctccaaagtctgatggaggaaatgaaagagaatcgacgctatccagacctctttttccagcaatttcagtctttgatttataattttgaataaacaaagagacgcgagggcctggcccaatcgcgtcttttctgtcttaaaaaggtaatttacctgcaaaggcacctagttttttctgagttgcctcgtcaacttttgtaagtgcagcgttgacggcttggattgtcatttcttgcaaggtttcaaggtcgtctgcatccacaacatcagccttgaagtcgatagaaaccaatttcttatctccagtaaaagtagcagtaaccaagtcttgtacagagctaccagtaaattgagtagcagccaactcagcttgactcttctccatttgtttttgaagtttttgagcttggcgcatcatgttttgcatgttcatcataagatttttaagattcctttcgtatcaaggggttagaccctgtttgtaaattttccttgccttatgttaaactttttcaaaggcagaggggtagtaaatattataacatgttttatgtagataatgctaccttcttaaaataagttatagtcagcaatatcggatataaatttgacatattaatctattttaaattgactttgagggataaattcgctataatataagaaaaactggttataaccagaaatcacggaggaggagctatgttccgtttagcaaaagaagaacttgaaaagttgggagctattattacggcgaccgaaatttaccaacagccaggcttatggaaggaagcgtatcaactctattttgaccaattggaaaaaatcgagagttttctaaaatcaatcaaggaaaaacatgactttgttcacgttgtttttacaggtgcagggacttctgactttgttgggcaaagtattgccaactacctcaaccaagtcaatgacttgaaacacattcgtttttctgccattggtacagtggagctggttagtcgcccacatgactatttacaggcagatgtgccaacggttttggtatcctttgcccgttcagggaattcaccagaaagtgtggcagcagttgaagtcgctaagcaattggtagataaattgtatcaagtgaccattacctgtgcacccgaaggtaagttggcactagcggctgaaggagatgctgaaaatctcctgctcttgcaaccggctggatcaaacgataagggctttgccatgacaggttcttacagctgtatggctctgacagccctcctcgtcttctcgtcagccagtcaagaagaaaaagctgcttgggttgagatcattgcccgtctaggtcaagatgttttggaccgtgaagactacgtgcaagacttgattaaccttgattttgagcgagtgatttacctcggttcaggtggtttctatggtcttgcccacgaagctcagttgaaaattctggaattgacagcaggtaagattgcgaccatgtacgagtcaccactcggtttccgtcatggaccaaaatccttcatcaatgaaaagaccttgattttcctctttgcctcaaacgatgcctacactcgtcagtatgatgtggacttgcttaatgaagttcatggtgatggcatagcagagcggatagtggcattgtcggctgataagttagtcggtacagaagcagccaactttgtcttggcagaaggcggagcagatctgccagatgtcttcctaaccttcccttacatcctctttgcccaaacggtatctattatggcagccattaagtgcaacaacttgccagatacaccatctccaacaggcaccgtcaaccgtgtggtgcaaggtgttatcatccatcctttagaaaaataggcagatgcattcaacgatgaagaaacagagctattcggtagagttttaacacataaaaaacacatccgaccacctgaatatcatggtacaataataatatataataaaatatgattaggacttatagaaatggaaactgcaaataaaaaattcagatatagtattcgtaaatttaaagtcggcgtaggctcggtgctgattgctacttgcttacttggtgcgggagtctcgacaccaaccgcttttgcgacgacagagacttcaacagctactcaagttgaagcaatggcgaaagttgaagaagttcagaagcttgtgaaagaattagaaaaagagctgggggaactagataaggttccaagttatggtgatgctcaagattattcttatcagaaggctttgtgggaagagtttttaagaattggaaaagataatatggactatgcttcaaaaatgaaagcagatgacaagtttttccataaggttaaaggggatttgaatgattttaaatatcaaataaaagtggaaaactatatccgtcaggttgcagaattgcgaaagaaataccctggtgataatacaattgaggaagaatataatgcgcatttaaagcaagacgaaggcaagagtatagctagccaagagggcgctaccttaagagactacgttgatagagaagcaagtgaggccatgggcagaattaagcaacgagttgctgaactggaaaaatcaaaacaaccccagccaagtcccgcagatgagccagctccagctccaaaagaggaagacactccagctccaacaccgaaagtagaagatgaaacacaggagccgaaaacagaagagaaggcaccagagacgaaagaagaaactccaactccaacaccaaaagaggaagggattccggcaccgaaagaggacgaagttccggcaccaaaagaggaagaaaccccagctccaaaagaggaggacactccggcaccggacgcagccccagctccagctccaacaccggaagtggatccagctccaactccaattccagacactccaaaggcagaggaagaggctccaactccagtaccggacactccggcaccgaaagaggacgaagttccggcaccaattccagacgctccaacaccgaaagtagaagaggaaacacaggagccgaaaacagaagagaaggcaccagagacgaaagaagaaactccaactccagcaccggatgcagagccagctccaactccggtaccggacactccggcaccggacactccggcaccgaaagaggacgaagttccggcaccaatgccagatgctccagcgccgaaagcagaggaagaagttccagccccaactccaatgccagaaactccaatggacaaaccgaaaactgataaagtagagtctgacaaacagatgccagaggctaagcaaccagaaatggagcaaccgaaagcagaagacatgccgaaggaggaaatgccaaagtctgagcaaccaaaagcggaagactctgcacctaagacagcagttccagaagtcgcaccaaaaacagcggaaaaaccaaagctagacttcacaacaaaagaacgcaaggtagaagaagctctccctatcaaagaagaaatcagatatgatgcaagcctaccgcttggcaaatcataccttcttcaagaaggaaaagcaggtaaaaaagtatctgtttatcaagatgtcatagttgatggtaaagttgtcgcaaccaacctattatcagaaactgttgttgaaggtcaaaatcgtatccttgtaaaaggtagcttggaaatgaagaaagaagaagtaaaaacaactccttcagtacaatcaaatccgacactaagtcataagggcgcaccttctgcaaacaaagcaaccctacctgcaacaggtgaacagcgcaataacctagccttagtaggccttggtttagctggaattagcttggcggtagtcgctacagctataaacaaaaaatctaaagatcaaatctaaaccattatgaaataataaagaggcagggcggaaacgcccagcctctttttagaactgaaaatcaatattatactcttcgaaactcaaaatcagacgttgttgacttgatttgatgagtgtcaagctccagtggagcttgacagcctgctaccataaaataagaaagtagcaggggtatatctgctcttggagaaacgaacttcgttcactctatctccaaccttcaaaggtttcccaaacctttgaaactagtctgattttgattttcattgagtattagtgcggtaaaattaactgtgattgacttaaatcaaggtggatttgccattgagaattatcccgaacagtacactcaaagtcggttgtatagagaatcaactccaagacatcgccttttttcagctgataaatggtcggctgcagtttccaggtcagattcatccactgtccaggcaccacttcctcgacagtcatcaggtcggtgcggttttgcaggttcataaagcccttggttaccaagcgttgtggcatctccacatagggcaactccaccagattttcttgggcatggtaacgaccgttgtctagactcaatcttgctttaggcgcagggattggggctaggcgttttttatttcccttgtccaatagctgagcggataagaggcctttagctacactagaagcgacacggagtttcagcgtgacctgcccgttaagcaagaggccctccgttacaggcagttcaatgctgatttgattggctttgcctgcatagaggtcttggtggaaggcagagtaggatttgccgtagcgttcaaaatcttcttgggtatactgattggcaacggtctggcttccagtacctagtggcaagacagtctcgttttcaccgccaaaggtgtccaaggtcgtccaagtttgctcaccgctgttgtcctgccagataaccgttggcagttggtagttgttctcgtagcccagtagtttctgactgagcagggcgttcatggactcgcggaagtcgatagactgccagttgttcatataaacgtgggcaccgttgtggaagaagaggtgcttcttgatgtgactaggtagggcatggaacatattccagacatggattggcttgacattccagtcctgtgagccgtgggtaaagaccacctcacacttgaccctatcagcgtggagcagataattgcggtcatgccagtattgattgtagtcaccgctggtgcggtccagggcagcacgctcggcagccagtcctttttcgtaggctgctttattgcggaggaagtcacctgcttgcaaactcttggagtaggtcagggcggtcaagctgtccaaatcttcgcctggatagccaccagggctggtcaccagcccgttttcacggtagtagtcataccaagaggaaatccctgcttctgcgatgatgacttccaatccgtccacgccagttgttgccaaggcattggacatggtaccgagataagacagtcccgtcgtcgctaccttaccattggcccaatcggccttgacctcaagcgagcgagtgtggtctgtgtaggccttggtgcgaccgttcagccagtcaatcaccgctttatagccctccacctgttggtagtcgccagatgtcatgtagcccgtcgagcccagcgtgccaacaccagacacatggaggctggcaaagccgcgagcgaggaagtagtcattgagggagtacgaagtaatgtgccccagtttttcagtagcagggctgacaggcaggttccgttggtccaagtctaacttggtgatgctggcctgcttgacctgaatggtaccgacttgtttttcagccagttccccttccatcttatgcagagccttatcgctggctacatcgttaactccttgatgataaggactatttgtaatcaccgcagggattttcccgtcaaagtgaggacggaggatggacagcttaacaatatctgtctgcccagtcccagctgtatcaacaggcgtttcgacatagaccacctcacgaataaggtttttggttgaaaaggttgccatagatttgccgttgaagaagtggtagtgattgtcctctggaatcaggtcatcgctgactagctggtcaatcaaggtgtttccagacttggtgcgagtattgaggagctggtagaggttgtcaatgatgtccccatagacaatcgggaagttgcttttctccacgaaatccatgacatctgtataatccataccaggcacaaagcccagcaactgaaaggcgacttgatagaaaatctggtcagtcaactcacggtcagactggaagaaggtcagaagatctgtgtcccattctgcgatcatgtttgacagggcaaagtcggtgtttgctgtcaggaaatggcactttctgacaaaggtttctaaatttgtcttactacttgcatcaggaatcagttgaaatcccagagtatcaagttcttgcaagtagacggaggtctctttttttatgaaagaaaattgattaaagcgcataaattctcctcttttttaggataatagtctataatagctattatatcggataagtcaatgtttgtctaaaaattatcagtatatatagagatattaatgtataaaacgacgatacaattacttgtaaaatgatgaaaatttttatacaatattgtagaatgactgaggagtgaaatgtatcgtgttgagaaaaaatgaagctatagtccctattttacgtattaataatagggctattaaccaaggatttttagaagaaaatctaggaatgaaaaccaagctcgaagatggtccttttgctgattttggagatagaacaagtccagaagcgaagctcgttttgacagaatctcctggtaatcgcacccgtgctgtcgaagggcttaaaaaactgaataaaattgtgataaaagtagacaatgcctctgaaattgaagctttactggcgcaagggtcacagtatagtaagctctaccaaggaaaaaatggctatggttttgaagctctttcgccagaaggagacacctttcttttacacgcagaagcatctgttgatgacctaaaagcaatccttccacctgttccatttaaggtgcaggatgacttttctggtctgaccgcttttacagtagagtctgtctggattaataccccacaagctagtattagtcaagactattatgaggctatcctacctcaacaagcctttttgcgttttgttggagcagaaggtaaggatttattaactcctgcagaacaagtttgggatttagaaggcttgcgttttcccgtcgagcaagactttgattgggcgcatttggaaagccggttggaaagaccattctttaaagataaaaaagcgagctttatccaaacagttgacccaagtggtattgaattgtggttcgaaaaatgagacaagtaattttagacaaggtttcagagcagattgagcaaggagtatatcctggtgtcagtctggctttttttctgatggtcagtggcaggagtactatctagggacccaggatgggcatacgccagttgaggcgggtttgacctatgatttggcgtctgtttctaaggtggttggagtagggactcttgcgacttttttggttaatagcggagctttggagctagataggaccttgcagtcttattatccagcttttgcggatagtgaggtcaccattcggcaattattgacccatactagtggtattgatccctttattccaaatagggatagtctggatgccgaccagctcaaggaagcgattttgaagattgctgtaacggataagaaagctttcctctacacggatattaattttctcttactgggctttttgttggaggaattgggtagagacagtctagaccagctgattagtcgagacgttctagagccctttggtatgttccgaacctcctttggaccagtcagtcaggcggtgccgacggttcgtggcgtcaaagcaggtgtggtgcatgatcccaaggcgcgtgtcttgggcctccacgcgggaagtgcaggtctcttttcgaccgtcaaagatttggaaatctttttggagcgctatctaactgaggattttgcggcgaatttaacgcaggattacggttttgatgataaacgcaagcggtctctggcttgggataagaagggggactggttgtcgcacacaggctatacggggacctttatcatgtataaccgtcccttgcagaaagctgcgatttttctctcgaatcgtacttttgacaaggatgagcgcgcccagtggaagttggatagaaaccaggttatggccttgattcgtcaggtcttggaggaagaagaggctattgactaatactcttcgaaaatcaaaattatccattgtcaacttgccttaatgaactccagttctatcttcgacttcgtttcttaggctacttttgattttcattgagtatatatcagtcatttagtttttcttttattacttcgacgatcgaggaaacatcgtttccttatttccaacttcaaacactccactggagtatttgaactcgctttgccgtactctgcaggggggacttgctccgcaagtgctatctccaaccttgcacagtcactcgactgtacaagctgtccgcagctcgttgcctagtactaaaagtaaactaaaagactataactatccttccgcaacactcagtagatttttcgacatagtaaaaggacctgcatgtgcaagtccttttgtgtctgcttgattaagcttgacctgaaacttcagcagcgtggtcgtccattgaaagaacttcgtggaagacacgttgagtcaattcagttttttgctctttagtgaggtatttagtgtttacgcagtatccagagatacgaacgataacatcttcaccagccatgattttttcataaacgtcgttcaagtccataacgttcaagttaacgtgttgaccaccttgctcaaagtaaccatcaaggattgttaccaagttgtttacttgctcatcgaatgttttaccaagcgcttttggagaaacttgagtagtcaatgagataccgtcgttggcatgtttgaagttgagtttagaaagggtattcaagttttgcaaccaaccaccacgagctttagaagttgggttagcacctggtgggaagaattctaccttagtagtgttcacagaaccatcttcattgaggaatacaccacggtgaactggagagttacctgtttgtttagagtaagcaacgttagaagtgattgtcaagatagatactgtagcttcagcattcttgtacaatttatgtttgttcaaacgagtgaagaatgcttccatgagccatttcgcaatatcatctacacggtcatcgtcttcaccatagcgtgggaagtcaccagttacttcgtagtcgtagataaatccatcttcatcacggattggtttaacttgtgcatacttgattgctgacaatgagtcaacagtgtttgcgaaaccacagataccgaagcccatgttagcacgaaggtgagttggcaagaatgccatttgaactgcttcgtagttgtatttatctgtcatgtagtggatgatattcatggcatcaacatatgtatcagtcaaccagtcaagggcgatttcaaagttcttaaccacttggtcgtagtcaaatacttcagatgtgtttggttcaacaccgtcgaatactttgtaatctttgtgaacgtcatcgtaaccgttgttccagcttgaaagaagggctttaaggacgtttacgcgagcaccaaagtattggatgttgtggcgttggtcttcgctttctggatcaagtggagatacacagcaagagatacatgacatttcaccataaccatctttcgccattgttgtcacaccttcatattggatagaagagtgtttgtggctcattgccatacagtagcgacggaatgaatatggaagttggtctgaccaaagaactgtcaagtttggttctggagagttaccgatgttgtcaagtgtgttcaagaaacggtagtccatcttagtaacacggtgacgaccatcgttacccatacctgccatagatgttgtcaagaatgttgggtcaccagagtagatttcgtcgaaggcttttgtacgagcgaatttcactgtacgaagtttcaatacgaagtcatcaacaaattcttggatttcagcctcagtaaatgtaccacgagccaaatcacgttcagcgtagatgtcaagtacgattggcacacgaccaagagaagttgctgcaccgttgataacacgacatacagccatgaaagcaatgtttgtccattggatagcttctttagtgttcattgcaggtttgcgaacatcaacaccatagtgatcacctaagcgtacaacttgttgcaatgcttggtactgcatgttgatttcttcacgaagacggattgattcttcatcgatttcagtaatggcattccagtcagctactttttcttccatcaagtagtctgcaccgtaaagtgccaaacgagcgtacataccgatgatacgaccacgtgagtatgcatctggaagaccagaaacgtggtgtgagtggcgagcacgacggatgtcagcggtgtaggcacggaagataccgtcgtttacagttgtagcgtgttttgtatagatttcatgaaggagtgggtctggagtatagccgttttcgataagagttgtttcagccatacgaataccaccacgtggcatgaaattgagtttgaagagctcatcgttttggataccgaagatgagttcgttctctttatcgatgaaacctgctggaatatcagcgatagaagtagcacgatctacgtccattgggaagcgagtgtcttcgtagccagcttttgtttcttcgatgatttttttgatatgaagtgaacgctcagttgggcctgcgaggaagctttcatctccatcgtatggagtgtagttggcttgaacgaagtgtgttacacttgccttatcttgccaatctgtacctttaaagccttcccaggcttgggcgaaaatgtcttcagcaacattttttgttttaacttttgttgacatgagggttctccttttatgcttttgggtatcgacttgctatcgataccaacatgtcattattataccatttgaaaacactttctacaagacaaaaatacttgaaaataaatgaaaaacctttcaaggaatatgaaaaaaattgaaatatagagttggtattttcaaaataaatttctgcttgtatttgtaataaggtgataagctgtcgtttattgtattggtaagatggctggttcaacgaatctaaaggctgaaacttcctaagaaatgcggtataatatagcgagttaaacttgtaaacaggaagaggcagtcatgttaatttttcccttaatcaatgatttatctagaaaaattattcatgtagatatggatgctttttttgctgccattgaggtcagggatagccctgctttgaagggcaaacctgttatcattggggctgacccaagactatctggcggtagaggagtggtgtctacctgtaattatgaggcgcgtgcctttgggattcactcggctatgtcctcaaaagaggcttatgagcgttgtcctcaggcgattttcatttctggcaattatgaaaaatatcaggaagttgggcgacaggttcgagaaattttccatcgctatactgatttggtggagcccatgtctatcgatgaggcttacttggatgtaacagaaaataagttgggcatcagctctgcggttaagattgccaagcttatccaatacgatatttggaatgaattgcatctgacagcttccgcaggtgtttcctataataaatttttggcaaaaattgcctctgatatggaaaaaccgcacggtttgaccttgattctacctgaagatgctgttggtattctcgcctccctgcctgttgaaaaatttcacggtgtggggaagaagacggtggaacgcctgcatgagatgggggtctacacggggcaagatttgctagatgtaccagaaatggttttgatagatagatttgggcgttttggcttcgacctttatcggaaagcgagggggatttctaattcgcccgttaaagtggaccgtgttcgtaagtcaagtggaaaggaaagaacctatcgcaaacttctttatcgggaggaggatgtcctgaaagagctaatcagtctctgccaacgggtcgcagccagtttgaagcgaaatggaaaaaagggtcgaacaattgttttaaaggttcgttatggtgatttttctaccttgacgaaacgtcatagtctagaggtatatacggaccagacggaaacgattgagaaagaggttcgtcaactaattgaagaaattgggaagattgaaaaagggattcgtttgctgggtgtgaccgtgactaattttcaaacttgagttctgtttcagtctatgatagactgaaaaaaaggagaagagatgcaaatttcaagtagatttaccattgccagccatatcttggttctcttggctctggaaggagaaaaagaaaaacagaccagtactagcattgcaggcagtgtcggggttaatcctgtcattatccgaaatattttgtcccaactcaaggaggctggtctggtagaagtagcgcgtggtattggaggtgctcgcttggcacagggtccagaccagattacacttttgcatgtctatcaggctgtggagttatttggagaaaaaggtcaattattcgcttttcatgagcaaccgaatctttcctgtcaagtaggtcgcaatattcatcctctgctagatagccgtttggaaaatgctcagtcagctttggaaaatgaacttgctaagacaaggcttgctgatctcttggcggaactatagtcgttttattaggtcaacgtaaggagaaactttgtttccctatttcctacttcaaacactccactggactgttgaagtaatctgtagagtgttgccctagcactaaaagactggttagtgaatcatccttgtgatgattttttaaatttttgagttgtaacaattgactttacaatcaaaaagatttatacttacgttgtaaataaagttgttacaacaaaacaagtgaggtatcaatatgaaaattgctattattgcagcgaatggtcaagcaggtcaaactattgcaaaggaagcagtagaacgtggtcatcaggtgacggctattgtccgttctgaaaacaagagcgtagcccaagaagtaatccagaaggatgcttttgctcttaccaaagaagatttggcaggctttgatgtagtagttaatgcttttggtgcttggacaccagaaaccttgccggatcacgcccgtcttgctgagcatctagcgaccatacttgctggtagtccaactcgtcttttagtagttggtggtgcaggcagtctttatttagacgagagccagacagctatgctgaaagatacaccagatttccctgcggaatacctgccaatcgctgaggctatgggtactggtctagacctctatcgtcaggcgacagcggtcaactggacctatatcagcccagcagcagattttgatgcagaaggtcaaaaatcaggtgcctacactttggctggcgaggttttccaagtcaatgcccaaggtgaaagctatattagttatgccgactatgctgtggctttggttgacattgcggaaaaaggtggctaccagcaggaacgaatttccgtacttgcataaaaaattaaatggtctaaaagatagctccatcgaggaattatctttttattttttacttgcatatagtataataatataaataaaaagaaaaggagaaccccatgattcacttgatttgtcccaatccagccctagaccgcacgcttcttgtggaaaagattgaaaagaatattcccctgagaccgacggaagtgagggattatcctggtggaaaaagtttcaacgtagcctatgcacttcgagaaaatggagtgacagactacactatccataccattttaggtgggcagattggtcgctatattcaggagcttaatgctgatggtggaaatgccctgcgcgtggttgaaaatagccagaatactcggacatgtaatatctatgttgaaaccagtacaggcgatgtagtactattttatgaaaaaggttttgaactaacagaggatttgctcaaccaattcactcagcagattgaaaatagcctgcaagctggcgacatcctagtcttttcaggtagtctgatgaaggggatgtcggatgattatattcagcggtttattgaaaaatacccagaggttctgaccatagtggacaccagtggaccagctttacgtgcggcttatcaagctagaccggcccttatcaaaatcaataatgaagagctgaaagatatttatccagagctggatgaagaaagtcctgaagctattttaggtatcctgaaagaagtgactcctcatgagaatatcatcattaccatgggagacaaggggagtctagctaagattggtcagcgcttcttccgtattcagtctccaaagaaagaaacgcgtaatcctattgccgcaggggatttctacctgggcttgctagtcaaaggaatcagtcaaggtcaagccccagaaatctttttgaaagaagcggcagcctttgcaacagccaattgtttgaattattttccagaggttgaagcagagcagtttgaagcgattgtagatacaatagtactagaggaactgtagtattgtatccctttactcatcgtgctataatggcaaggagaaacaaggtgagatgggggatagtagtggaacagttgacggttctttaccaaaatttaaaacggcgatatggtgaatttcactggtggaatgatgaaaatcctataaaggatttggtatctatgatccttattcagcaaacaacggaagcaaatgccaagcgtgctttagaacagttggagggacggttgacaattcattcgcttttagagatgcctgtggaggatttacaagaatgcattcgcccagcaggattcttcaagcaaaaatcactctacattcggtcagtggttgagtgggccaatcagttcgatggagatttttctcgcctagatcgtgttgagacagcagtactccgaaaagagctgctgagcttgaagggggttggcaatgaaactgcggatgttattttgctctatttgtgtcgaagaagtgtttttgtggcggatcaatatgctcttcggctatttaatcgtttaggacttagccagtctcaggattatttgagtttgagacaggaatttacagagcagataaaagattggtcggtaaaagacgctcaggagcttcatgcactgattgatgaacatggcaagcagttcaggttaacaaaggggcagcttgatgaatcatggttgatgatatagtcatactcttcgaaaatcaaaatcagacgttgttgacatgatttgatgaacctcagttctatctgcatttgcatcgcctagcttgattttgattttcattgagtatcaattagtgtattttttattactgaagggcgaggaagtctcatttccttatttccgagtttaaacactccactggacagttgaagtagcctgcatatcgttgccttgtactaaaagcaaacgaaacgactataaaagagtaaaaccagcggttcagttggttgctctttttttatattaattggagttattttccaagataaaatgattatagactgctaaggatgctgctccaattgcacctcgaaatatattaaaagataagaattcaatatctaaattatttttacttggaataaattgcaattgattgtcaacaagattattaactttttctgaaaaacctggataatttaataactggctattaataaaaattttttttgaatcataaatgatcaatgtatttgcgattgaggtagttaaaaaatcaatccctgattcaattttttcaataataaaaccatctcctagtcggtatgcattgtatacaacatctaatgtaatatcttctggtttttcaaccaaagtttttatgatagaaccttgaacattctcaaataaaaatcttgcattattgattaaccaagtatcagaaatataagtttgaaggcatccacgttttccacattcacaagaaggtccgtttaaatcaactactgtatgaccaatctctccaatataaaagtttttgttttgtaaaatatgttcactatcaaaaaatgaacagaacaatccaggtccaatatgaataaataaaaactgctctggcgaactttcgggatgaaagagatatgaaccaattgccatgcaattaatattgttctctagaaaaataggaattgaaatactttgtttaattacggcaagatcaaaataaatccactttacattatttgaaataatatgtcctgattttgaatcaaagtgaccaggtacagcaataccgagagctccaaattcaagataggaaaacttatctagagtttcagttactaattggataattatttcatttatttgtttggaatcatattctgtaatttttatattgctatttgtgattaggtttccaatagtgtctgtgacggctaaatagattccattggcattaatctcgattccaatataatgtctatattgagagtttactgtaataagtcgtctactacgacctgatccaatataatctcgaacctcatcgccagtctcaataacttttttttcagctaccaggtaactaatcatattcgtaatagttgccggtgtaatttttaaagatttagaaattcttgttctagagcttttttgatgtctaaataaagtttttaatatatttccagaaatatttcgaatggtttcttctttttttcccattttagtacctcacattggaaaatagtatttttcaatgtaagaataacatattttttataaaaaatgaagtaaaaacactaaacaaataaataaatttcattttttaattaaaatttataaataaaaacttgacaattaagcgcttacatgatatctttaatttacaaaataaaattaatggaggataagaaaatgaatggattaatgcattttcttgaacataaactagctccttttggaactaaggtagggaatcaacgtcatttgaaagcagttcgtgacggttttatgatggctatgcctcttgtattagttggctcgttcttcctattgctaatcagttggccggatcaggcttctgggggattttcagtagtaggctttttagagcaaattggtttgttggggattttaaatcggttaaatcaatcaacaatggcgattatctctctcatagctacattcggtattgcatatcgattatccgaatcatatgagacagatggaccttctgcaggtgttattgctttatcatcttttattttacttgcgccaagattctcaacaatggttttcaacgaatctggtgaacaaattaatcaagtatttgctggagcaattccatttggaagtttgaacgcaagtgcattatttgttgctattgctgttggattagtttcagctgaaatttatcgtttctttatccaaagaggtattacaattaaaatgccaaaaaatgtcccagacgttgtgggtaagtcatttgccgcattgcttccagcattaacaacattaattttctgggcttgcgtcttccagggattagaagctgctggtgttgaaggtggacttggagcggttttgggattaattgtaggtaaaccacttggtcttattgcaggaagtctcggtggaatggtgcttgttgtgcttgtaaattcacttttctggtttactggtgttaatggtggacaagtgttaaatgcttttgtcgatccggtttggttacagtttacagaagcaaatcaacttgcagccgccgcgggagaaaaattaccacatattattactttgcctttcaaagatttgttcgtatttatgggcggtggtggcgctactgtaggattagcgctttgcttacttgtctttagtaaaagtcgtacatttaagagtttaggacgaatctcctttattccttctctctttaatattaatacagccattctgtttagttttccaactgttttgaatcctattatgatgattccgttcattctaacaccgacagttaatgcaataattacctattttgctatggcaactggattagttccgatgactactggggttgttctcccttggacgatgcctccaattcttggggggttccttgctactggcggcagtattcagggagcaattttacaaattattttaataggtgtctcattcattatttattatccatttttcaaagtggccgataataagaatttagagcttgaagaatcaggagagtgatcatatgaaattgacgatttttgataaagtacagaataagacttctcaatttgctatagatgaacttacatattacttgaaagccatttttgattttgagttaggaaagacaactgttgaggaagatgcgaatgttcttttgtcaaaagaatatcttgacaataatgatacgattgggattgaaatgaaaaatggaaatgcaatattaacaggtaattctgatgtctcaatccttattgcggtatatcgtttacttagtgaatttggagctgtattcactagaccgggtagaaaacatgaattaatcccctcattaacgataactgactggaatgagaaagagctttctattcatgagactgcaagttataagcatcgaggagtatgtatagaaggtgcagatagttaccagaatacaaaagaatttttggattggttacccaaaattaatatgaatagcttttttattcagtttgagaatccttattcatttttaaagcgctggtatgaacatgaatttaatccgtatgcggataaagaagatttcaatacggaaattgcacaacaaatgagcgaccttttagatgaagaattatcaaaacgaggtttaatacatcatcgtgttggccatggttggactggtgaagtacttggatattcatctaagtacggatgggaatctgggttaaaactacctgaagaaaagaaaccgctagtcgccgaattaaatggaaaacgtgagttattcaacacagcgccaatactaactagtctatgtttctccaatccagatgttggtgaaagaatgtgtgaactgattgtaaattatgctaaggaaaggaaagatgtagactatttacatgtttggttatccgatgcacggaacaatatttgtgaatgtgaaaaatgtaaacaagaaataccctcagatcaatatgtacgaatattaaatcaattagatcggaaattaagtgaagaggggcttaatacaaagatttgttttttactttatcatgaattactttttgcaccaaaacatgaagttttagagaatcctgaacggttcactatgatgtttgcaccaattaccagaactttcgaaatgagttatgcagatgtagactatgaaaacgatgttccgcttccaaatgagtattcaagaaataatattgttcttcctaactcacttgaagaaaatctctcatatttatttagttggcaaaaagtgtttaatggagatagttttgtatatgattacccacttggtcgggcacattatggtgatttaggatatatgaagatcagtaaagtaatctttagagatgtcgtatatcttaaaaaattgggtttaaatggttatattagttgccaggagctacgcgctggtttccctcataactttcccaactttgtgatgggtcaaatgttgtggaacagaaatttagagtacgatgaattgaaagcgctctattttagttccttatatggttctgaatggaaaagtgtcgtaacttacttagaaaaattatcagattactcttcatgtgattattttaattcaataggtgatcgccaaaatgcagaattatcaatgaaatacaatatctcaagtaaattagcatttaattttattaataccttggaagagaatgttgctaaaaataacggaattcaacgtgatgcttggcgacaattaggttatcaccgggaatatgttgtcaaattggctaatgcccttcatcttatggcctctggagaccatcttgatggacaaatccgctggaaagattttttggattatattagaaaccatgaacctgattttcaacagtatcttgatgtctatcgtattattgaagttgctaagaattatgctggattcaaattgtagtactgagttgtagaaaaaagccaattcacaatttattttgcgaattggcttgaagtctaatatagatagaatattgaatttatttgatgttaattgatatttatttttgagaggattttatgaataaaaaaatttttttaaaatcagcgattattttgctctctgtcacatgtctaattaatgcgattaaagctttagatagtagtggtgtgtcatcgagtacaggtgaaatagtaaatcaagatcgcatatacaacataactttgaaagtgaaaacagatggggtttataatgatctgggggggaatgttatttcggaaaataatgtattgtcaggaattagtggtacaaaaataaatttgaaggttagtacaaattcaggatatcgttttgtagggtatcagtcatttttagaaagtggaaatagtacagatgggttactaccaatcgaaaatgatagttttgaaatctcggataaaacgggtaatgtaacggttgttgcgatgtttgagaagattcctattgatgagacaatttatttttcggatgaattctcaactgaaaatattaataattacttgttatctgaaaatctaattggaaaaattgcggtaagtaatggaaaattgaacattcatgctcccggggtatcatcgataaaaccaattctttcaagacagattgatgaaagttcaacattggggtatgaaattcaattttccatacaacaaattggtgaagtaaagcagtggaatacttttagagtagtatttaaagaaaatagcgatggatcagtttatgctctagaatttactggaaaagctgtatctataaaaaaactttcaagtattgatgcacctaatcaaactggtgaaaaatacgctgaaacaggccacaatctaggaagtgaagaacacagaataagacttgtagtaagaggggatacagtaactgttagtgataatgaaattccgttattaagttatagcagtcctgaaaattgggaaggtgcaacagcatccattgtttttacaccgatttcaaatagaagtgtatctttagacgatatcattattcgacaaacacgtgctttaagatctttactagttgtgtctcgtatagatggtcaggaagttacagatattcaacccggatcaatcagagggaatacaagtcaagtttttgttggagattcacttcctctggaggtcattgaaaaacctggatatcaatttattggttttaaagatgaatttggaaatgtggtcgatttatctactttcagtgttcctaatgatgagtcggatttggttatttatgcagactttcagacagctgaagtagtgaatcgtgagacaaagactttttatattgatagtatagaaggaaatgatactaatagtggagaaagtgagactaatgcatggaaaacactcgaacaattgcggaaaaacacactaattgctggtgatagagtgctattaaaacgtggaagtcgttttgttggagaagatgcggcattaacttttaaaggttcaggtcttgaagatgcgcctatcctaatttcatcttatggtgagggagagctgcctttgcttgaagcacagggcaaaattgaaagtgtaattaagttatataatcaagaatatattacaattgaaaatctagagattacaaacttagatccgaacttttcaacgagttttgaattaaattcaaataataaccgttcaaaaatactaagaggtgttcatgttatagctgaagattatggggtagttcatgatatcgttcttcgaaatatgtatctacatgatattaatggtaatttgaattcaaaatggaatggaggtattttctttgatgtttatggaacaacagttccaaccaaatatgatggcatacttattgaaaataattatttagaaagagttgataggtcagggattaaattggtcgggtccacatgggcaaaccaaaatctaaaaaacaacaaaaacattccattaaattggtatccatcaacaaacgtagttgttcgtggcaatcgtatcgaaaaggctggtggtgattctataacagttagagatacagatggtgctttaattgaatacaatatctcggctgatgccagataccaagatacaggttataacgctggaatttggccatttcaagcttcaaatactgttattcaatataatgaatcatttagaacccatggtgttcaggatgggcaaggtttagatctagaccatgtttcaaataattcagtaatgcaatataattacagtcatgataatgaaggtggtttcatgttgattatgaattggtacgagcaaacatctccaacagtccgttataatattagtcagaatgataaagataaaatttttgaattggctagagggggagcccaaggaactgctatatataataataccatcttctccgactcgaaattaacagggagagctggcgttattgatatgccgagtacctcaggaggaactggtgtaaaagatatctttttatttaacaatattttttactttactgatggcgaaaaaatgtttgtagaagcaagcgatgctggtaaatataaagatagtattcatttttataacaatgcatatgtcggagttgaagtgccagatgatcccaaagcgataactgaaggtataactttaaaaggtgttggaactggaccgactgaaaataaatcgatgattgcaaatgctgggaaatttttaacaggacaattagatgggtatagattgcctgaaaatagttcgttagctaagcttggtgtgagcaaagaggaagcaatttcttatttctataaaaaactaggtgtgcagcccacaattgatttccaagataatggctccttaactatgtctccgacagaagcttttgccttggctcgtcaaacaaacagtgttgacgcgattgcacgtgtttatcctgcaatagaaggggttacttatgatactgatttctttggagaaactttgtcgagtgaaaatttatctgttggtgcagctcaagagaaaaaatcagtttttgaagaaaaaatctctgatatagaaatttcagatgtgaaaacagggattggaatgagatataaacgttcaaatcagcttgcagatgtaaatttaagtataagattgataaataaagatgaacttcaatatactataaatgctaataatccaactttttcatatgaaattcaacttcaaaaaaattttggagagtatatggatttaagtgagagtgtgacaatcaccattccaattgaggcggataaaaagattcttaatgttttgaaaattaataaaaatgaacaaactgaatcagtgaaagaactgccatatcgaattgaaaataataaaataatattagaaaccgatgagcttggttcatttatcattgaataccagatggaaaaaattaaaaaagaaaataacacaaatgcaacaataagtgaaagtggaaaaagtagtttagggttgcaaaataaagaaaattcagatgtgcaagctgtaggcgataaagattatttttctggtcttgaactatcaaataaaggtgaagagttaagtcgtgaagattctaaactaatggggaattcaattaataatttacaaacaataaaagagtctgaaagtattttcgaaggaaatttgggtaggaataaagagttgagtgacatgtatcaaaagtcattgccaaaaacaggagaaagtaaccaagcatatattgttttgattggtttatttagcctcttcgtagtcctaatttgtcaaatttttaaaaaatcaatagattaagggatttaggataacaaaatgacgaaaaaaataatatttatcttgttattcttcgtagtttgtgtttatttctactcctttattcccctcgttcagactgttccatctgtttttcagacaccttatagaacattagttcaatctgagtttgaagcgatatataaatataatggtattgaaatttcggaaaggaatttttggaataaaccgataaatggtcgtaaaccacaagatactctgaatgaaaaagcaacgatattatttaaaaaatataatcttttagaaaaagaagcgaaaaaacatgaatataaaaaagaggctcttgatttcaataaagttgattggaagacagtctcaaatcgctatattgaattaaaacaaattgttattgatgaaaaaattaaagatataaatcaagatgagattgaacgatattacttagcaaatactgaaaattttgaacgtcaagattttataagcggtaacatttctatatggaatgatgggataattatttctactgaatcagtagatattaccgaggaaacagtaagaaatataactgaaagataccctgatttagaattagaattaaagaatattgaagttggtcatcaagtttcttggggacagaatggggtttattatacctttacatgtttgtcgagagaagaaaagggaattattccactttctgaaatcacggatgcggttgctatgcaatgtgcagaggaacttgttgataattggttaaataaagaaattgactctttaaaataatccttgattattgacaatctagagttaacaaaaattttttgttaatttaaaaggaattgggaattgtcgtactgaaaaactgatttcaattattaagttaagtttcttagttaaatactgtaatttttgtagccatactaatatatattttgtaaaatagagttacataaatttattaagacgaaacattttttatgtatttgtaactatgggaggatgaagatgaagagcaacaaagaacaaaaatatttttggttgacattctcattgattgttgcattgatgatttggtggtttttatcgaattatgatcgaacctctcgtagttttccaaatatcattttggtttggaatgctttattaatcatgatagacaaaggatttatctttgaagatatattttcaagtctaacttcagttttcttcgggttcacgtcgggctttctattgtcggcgcctaatgcactcttaatggcctggtattcaccttatcgtaatattgtgaaaccttggatacaatttatcagaaatattccacctcttgcatacgtccctttagttgtaatttcagctggggttgggctattacctcaagttattgtaatagcgatagctacttttctgactatgactgtaacaatttatcaaggcattattaatatcgatccaaatttaattaaagcagcaaggattttaggagcatcagattttgaaatatttaaaagaattttggttccctcatctattccatttattatgacagctgtcagattaggtacatcgatttctttaacaactatcatagcagctgaatctactggtgcaacatcaggtatgggaatgagaatacggtccttaaataactcttttgattcctcgggaatgcttttgtatatcatattgattggagtgattggtttacttttaaataagttagttgatttgatagaaaggaagttaactggatggcaacagaagtaaaaaaaattaaggtcaaaattgaagatgtttcaaaatcatttcagacaaatcatggtgaggttgttgcactaaatcaaataaatttagaaatctttgagaatgaaatagttacagttgttggtccatctggttgtggtaaatctactctactaaacttggttgcaggtttggaacctgtaacttccggaaaaatttattgtgatgataatgaaattgttggcattggagttgagcgtggagttgtttttcaacaatatgcattatttccttggatgagtgtactacagaatgtaatgttcggacctgaaatgcaaggaaaatcaaagttagaagctagtgaaatagctaacaagtatattaaaatggttggattacaagaattttccaatcattatccgaaagaattatcgggtggaatgaagcaaagggttgctatagcgagagcttatgctgttaacccgtcaattctattaatggatgagccctttggagcattagatgcactaactagaattcagcttcaagaggagttgattgaaatgttaggacaagaacaaaaaacttgttttttcataacacatgatattgaagaggcggtactattaggaaatcgagtgattgttatgagtccacgccctggagaaattaaagaaattgtgaacgttgatttaccatttccaagaaatcagttgacaaagtttgaaaaaaattttatggacataaagaaccatatatggtcacttgtttataaagattttctaatataaaaaagtgaaacagtagaattattttgtgagagggtaaaatggctaaatatatgaaatataaaaacttcatttggtttatttgcagcataatcactctgatttttctttcttcgtgtagttctattcaaacctcctctagtggccattcagcaaaagttgacacaattagaattgcatatatgccaaattttgcaagtcttcatgacattataactggaataaattcaggtatctttaaagaggaggggcttgaagtcgaattgattgaatttgctgatggtccgactatcattgcatctttagagtcaggttcaattgatattggtaatattggtccgggtgcccataaattggcgattgaaggtagagcagaagttgttgcatttagtcaacttgggaatgctgacgaattgattgctcggtcggatagaggaattgattcaatagaggatttgagaggaaagaaaattggaacagcatctgggacatcagcagaaacaattctaaagcttgctttgttagaagcagatttgtctgaaaaggatgtagaaattattgatatggatgcctccgctattgttacagcaatgttgtcgggttcaattgatgtagctgcaacctggtcaccaaatacaacttttataaagcgagaattaaaggaaaaggtcgttgtactagctgataattcacgttatagagaacaatctccagctattgcttcatacgtaacttttccggggtattctgaaaaaaataatgaaaaaatttccaagtttttaaaagggttatatcgtgcaatggattatcgagctgaacatatgaaggaagtttcaaaatgggttgctacccaaatcggttcagatatcacagctgttcaagatcaactacaagatggagagtggttaacaagtagacaaatgattcaattgattaacactgggatacttcaacagtattacgagaaacaacaaaaaaatttaatagaatctgaaatagttgatacatccaggaacattaatgaatatgttctaattgatcaaatgaatagtatattaatggagattaaataattcttgtgaaacacaattagccattttattttcaataaaagttacattgaatcaataatcattcatagttttcaaggaaacatgaggtaatgcatgatagaatattacaattttagtaaaagtgaattagaaaaccatagtagaattccattgattataaaaaagaataatgaggaaatttttatttcacttgctctagaaatggtagaattaataaaagaaaataacaaaaaaaatgagaaaactgtcataatttgtcctgttggaccagttggtcattatccccattttgttagattagtgaatcaatttaagattgatttgtctgatgtttggtttataaacatggatgaatatttatcggaagatttacattggatagacgtagtccaccctcttagttttcgaggatttatgcagaaaactgtctacagtcaaatacatccaactcttattatgcctgaagaacaaagaatttttccagatcctcttgatattgacttgatttcaaataaaatcaaagagttaggtaaaatcgacttatgtattggtggaattggcctaaatgggcacattgcatttaatgaaccggattcaacattaacagttcaagaatttttaaaattagagtcgcgagtgttacctatctctgtcgaaacaaaggttatgaattgtttgacggaattaaaaggggctgtagaagaagtgcctaattattgtgtaacaataggaatgagcgagatttttcaagcgaaaaaaattcgacttgctgtttttcgtgattggcatcatgcggtcatacgtaaaacagtttgttctaagccagatactggatttccatcaactctaatgcaaatccatacaaattgttctatctatctaaatgaatcgttagcaaattaacggatgttcaaacacatatgaaacatatataagtctgttacccttttgatcagatacctaatgagagaggattctctcatttttttaatcaaaatcgtttacaaatgtaatcaaaaagcatgtgatttgactgcaaatgtagtcaaaaggagagcagtattatgaaaacatccatctataatgtcaatgggatgacttgcgcaacctgtgctctgacagtcgagaaagccttgaataagctagatggaatacaaaacgccagtgtgaatctagcaacggaaaaaacaaacattcagtatgatccagcccatctgagcttatcagatatcgacagctgttgaaaaagcaggttataaagcggtactgccaaaaacacaagagtcagaagctcaaccaagcggaaaagaacaacacaaaaatgatttatggcgcagatttatctggtcaaccattttcacgcttccactactctacattgcaatgggacctatgttaccaggtgggggattgccattgccagctatcttacaccagccgctagtttttgccctagttcagctcattcttgtattaccagtcctatatgttggtcgtgcattttatcaaaaagggtttaaaaccctgtttgccggtcatcccaatatggatagtttgattgccgttgggacaagtgctgccttgtttcaagggatcattatgacgattttgattgctaccaaccaagtagccacccaacatggacatcctgagctctattttgaatcggcagctgttattttaacccttatcactcttggaaaatacatggaggcattatcaaaagagcgtacttcagaagccatcagtaaactgatgaatctcgcccctaaaactgcacgcgttctctgtgaaggtcaagaagtgaccctccccttagaccaagtcaaagtaggagatgtccttcaagtccgccctggtgaacagattccagttgatgggataatagtagaaggccaatcgacaattgatgaatccatgctgacaggggaaagtttgcctgttaaaaaaacatcggggatacagtcgttggtgcgactctgaatcaacatggtgctttccaaatggaagcgacaaaagttggagcagataccacattgtcccaaattattcgtttggtggaagaagcacaggggtcaaaagctccgattgcgcagttggctgaccgcgtttcagcagtctttgttccaattgtaatgggattagccgtcctttctggccttgcttggtacttcttgggacaagagccctagatgttctcactttccattaccatctccgtccttgtcattgcctgcccgtgtgtcttgggccttgccacaccaaccgctatcatggttgggactggaaaaggggcagaaaatggtcttttgttcaagtctggtcaaactattaaaaccctacaaggtgtgaacaccattgtcttcgacaagactgggaccattactgagggcaagccacaagtgacagacatccaccttttgtctactaaaaatcgtgagcaagttctccaactggcagcaagcagtgaacaatactccgagcatccattggctcaagccctcttacgttcagcagaagaggaatcaattcccttacttgccagccaagattttcaggcactttctggtcgtggtctttcggtaacaatagcagagcagaccatctatctgggaaatgaacggttgatgcgggaacagggaattgatgtttccaaaggacgtgcagttgcggaaacatttgcccatcaagctaagacgcctgttttcctagccagccagcaagaattactagcagtcattgccattgctgataaagtaaaagagaccagccgtcaggctgtccaggctctgcaaaccatggaactagaggttgtcatgctgacaggagataatgaaaaaactgcccaggctattgccaaggaagtcggcattgagcaggtggtcagtcaggtcctgccagatgacaaggccaaccaagtcaagttcttacaagaacagggcaagacagtcgccatggtaggggatggcatcaccctgtctgattactatgaccatgcctttggaaaatcctacggtgtgctcatgcgggagtggaatttgctggcgcgtgcggtctttgtccttaatgccgacaatgagatcgtctacgtagaatacctagacaatgtcaacgaacacccagattataaagcagctttagaggctgtcaaataaaagaatataacggtgttcatctactgacttgctggtttttatgctttaaaaaattcttcaatatctgcctgttctatgccaatcatggggtcgatggttagtaggttgtctacagtcaaaatgtattctgtgggttggggacttgttttttctggctggtcttgatcaagaagggagagttgttggttgttttctttgactactttaacctgttcttttctgtctggctgagtagggggctgggtttgcgtggttgtagctgttttgctttcgtcttttttaatcaggctttccttgctttcctgctctgccatttccccttggaaacgtgggaccagataggtttttcggacggtgccggcgtttttgacggcgtagtcgaaggcggagatttcgcccaggaggatgagcttgctcttggagcgggtgatggcggtgtagaccagattgcgctggagcatacggtggctggtgcgggtgatggggaggatgactacctgaaactcgctgccttgggacttgtggatggacatggcataggccagggtaatcttgtaccattcgtttcggggataggtgacctcgctaccgtcgaagttgatggtaatttcgtcctgcttggagtcggtgtacttggcaggaaggaggtcggtgatgtagcctaaatcaccattgaagacattggcctcggcatcgttgactaaatgaatgacccggtcgccttggcggaaggcttgctcgttatgcaggaattctaactctccctcttccagtggattgagcagggcctgggtcatagtgttgagttggtcgatgcctgcggccccacggtacatgggagcgaggatctgtacctcgtttgcaggaatacctgacttgatggctgcgccgacaatgcgctcaatcagggctggaatttgttcattctgggcttcaaaataggaacggtcagcctttttctcacgaaaatcgctaggcagagcaccctgtcgaatctggctggctagggtaacaatggtcgaatcatcggattgacgatagatacgttctagagtaatgctgggcagcttgtcaattttcaagaggtcagcaagtacttgaccggggctgacagaaggcaattgctcggcatcgccgacaatcagaacttgggtctgggaggagatattctggaagagctggtttgccaaccaagtatctaccatagaaaactcatccacgatgataaagtcggcatccaaataatcatcacggtaggattcctcctgtccttctaccagaccgagatggcggtggatggtggcggaaggcagccctgtcaattcattcatccgtctggttgctcgtccagttggagcggctaggaggactgggcattcttctcggtttcgcgtcaggtcaatcttatgcaagatagcatagactgcgataatgccgttgataaccgttgtttttccagtccctggcccgcctgtcagaatgaaaagcggattggtaatggcttggacaatggcttctttttgaatgttatcgtaggtgagagaagatatgctttccagctctgctatggcagcctcgacgtctgcgcgtgggaagggcttgaagccgttttttcccatcaggcgagttaggtttgtatggataccatgttcggcaaagtagaggctgttgtcaaaaatctttgtgccttcttgctgtaccttgtcgtctgcaatcagtcccgtcaattctttggcaacagcagcggggtccagctctgtatggcgggatttttccagcagttcaagggttgcttccagcaagtctctggcctccacataggtatcgcctgtttccatggagcgatgaatgagactaaagagcatgccagcccgaaaacgttggggtgaatcactggcaattcctagattttccgcaatcctatcggcaatggtaaagccgagcccctggacatcttcgaccagttgatagggattttcttcaataatctgaagtgttttttccttatactggtcttggatttgaaaggccaatttattgggaatgccatactcggctagttttgccaagatcaactcggttccataattgaggcggagtttttcgacaaatgcctgcatgttcttgctggataggcctgtgatttgggttagtttttcaggttcagctaaaatcttatcaatggtatcttcgccatagagctcaacgattttttcagctgttttgcgtccaattcccttgaaatgctcgctggagaaatacttgaccagaccagctgaggtaggcttgctgcgttcgtaacgcgaaatttgcagctgctgaccatacttgggatgggtgaccagattgccatagaaacgatagtcttctccttcaatgacatcggcaatcgttccggtcacaataatttcgtagtcatcatagtctgcgtctgtctcctcgatttcaaggagaaggattttataaaaattactaggattttcaaaaataatccggtcaatagtaccggtaaaatacacttcgttcatagagtttatttccaataataatgaaaagggagtggggaagaactcgcatagaccaaaaagagttcccctcacttccaaatatgcaggttcgggctaaaatagtccactggactattttactcccaacccgcacagctccaacagtccagtggactgttaaacccaatcaaccactgcgctgggatgttgacacgaactctgagaagtggtgctgtgctttttgctccaaacttgtttgtattaatcaacagtcccaatacggttgagaggccacatgcgaaagacaacttctcctttgatgttttcacgggaaaatgttcctacactacgactatctagtgagacaaggcggtcatctcccatcaggtagtattgtccttctgggactgtcacggtaaagtctacgtaaccattggcatcttgtgtgaaagcttcagcagattgggccacagcttggaattgtttgttataagaatagacttcttgaagtttatctttttggaatgcagctagatattcatctaagtaaggctcgtccactttttggtcgttaacatagaggacatcgttttcgtagcgaatggtgtcacctggcataccaatcacacgtttgacaatcagtttttccttgccatcgctgtctgtttcgctggctacaacaatatcaaagcggtcgatagaggatgttttgagcatgatgagtttttcttggtgttgaagcgttgggtccatggaatggccatcgacagatacaggattccagataaagtaacgactggcaaaaaaagctgccataaacagtaaaaagatgccccattcagctaagaaggcgactagtggtgagcgttttgttttttggattgctcccatattttttcctcatttcaataatttttgtgctttttgcgtattggcaaagtggagtttggcagtttggttgagaccagccataccatattgttttaagatgcttgctgcgacttggtcggatttactgcccgcaccagacggcagatgcattccaactagttgaccaagctggacaagattttctaaaaacatacttcttgcaatgatagaagatactgccacagccagatacctgccctcagccttttcttctagagtgacggggttggcaaattggttggcttccttcttcaagtacttttgataattttgactggaagtgaaggcgtcaatgacaatcttctcaggctggacacccttttgcaagagtaggaaaatagcctgattgtgtagggcgaccttgacagacaccgcattgtagccttgctcgatgacttcgttgtattttttcggtgacaatagcagagcttggtgggggattttctcttttaagagaggggcgatttggcagattttttggtctgtcatttttttggaatcatcgacaccaagcgacttgagaaaggaatggtcttctgggcggacaaaaccagcaacgactgccaaacctccaaaataagacccgtttccaacctcatcggtaccaatcatgggcaggttttgaccaggtatggtcgcctgtccagagctttctggctcatagccccaacggcttgcttcctgctctgccatttccccctgaaaaacgacttttccagaagtgtagatggacaggcttgcaccggtcagtttgaaaaatgcttctatgtaaggatttttgctggtctgccgatagcggtcatagtgagccatcatggcttgtttttgctgggcagatgcctttagtacaacggtattcatgttcttattgtaacacaaatgctagttagagtgtgcagaaaagggtggaatttactataatggtagaagaaagtgaggtacactatggaagtgcaaatgaagtataaatgggcgactctgggaacaggtgtcattgccaacgaattggttcaggccttgcaggctatgggaggaaatctttattcggtagccaaccgtacctatgacaagggtgtggaatttgcgcaaaaatatggcatcgagaaagtttatcgagaaatcgatgaagtgtttgaggatcctgaagtagacattatctatatttctacgcctcacaatacccatatcaattatttgagaaaggccttgaaggctggaaagcatgtcctctgtgaaaagtctattacgcttaattcagaagaattagcagaagctattcaattagctgaggaaaatcaggtcgtcttggcggaggccatgaccattttccacatgccaatctatcgtcagttgagcgaagtggttgccagtggcaagcttggagagttgaagatgattcagatgaactttggcagctacaaggaatatgacatgaccaaccgctttttcaataagaacttggccggcggtgccctcttggatattggtgtctacgctctgtcctttgtccgttggtttatgatagaaaagccaaatcaagtcctatctcaggtcaaattggctccgacaggtgtggacgagcaggtagggattttgctcagcaatgatgcaggagaaatggcgaccatcgccctgaccctccatgccaaacagccaaaacggggcactattgcctacgataaaggctacatcgagctttacgagtacccacgtggtcagaaagcagtcattacctatactgaagacggtagtcaagaagtaatcgaagcgggcgagacagccaaggctctttcttatgaagtggcggatatggaaaaagctgtcgcaggcatcgaaaacaccatgcacctagcctacacccaagatgtcatggagatcatgacccaactccgtaaagaatggggcttggtttatcctgaagaaatgtaggatcttgactaatccgaaaatagaaatgagagtgagttagtagccaattgttggattactgccttactcttattttttacttatagtcttcgaaaatccagacgttgttgacttgatttgatgaagttttgttctatctgcatctgcgtttccgagtctgtttttgattttcattgagtattacctaataatatgacagtcagatgacatttatattgattgtgtgacagaaaagtcctaagattacatagtggagacagtttatttaaaagaacggttgaaggcttgtttttcagatttaatttaggtaagatagaaccatctcaaaaataatgaaggaataagattatgaaacgtaagagaacaaataaaccacaacatatgcgtcgcaagagaaaaacatccatcatgaaaaacaataagaagatgttatacacatcttcattggctctttccctctttagtacggggatgatttcgacaaatgttttagctatcgaatgggctccacgtactgtttctgaaattagcccagaaattgtacaagaagaaggaatgatgacctatactgttcagtatggagataccttatctgccatcgcctcagctatgaatattgatatggacttgctggcgaaaataaatcaaattgcagatatcaacttgattttccctgatacggtactgacgacgactgttgaccaaaacaatcaagtgactcaggttgagattgaagctcctgttcagggaaacacaaatgagaccgttcaggcaactgttgacctaacaaccaatcaagtaacggttgaggatacggttgttcccttggatcaaatttcatcagttaccgactcagcgcctgtagaggaagttgtagagcagcctgtagttgaggcacctgtagaggaagttgtagaacagcctgtagttgaaactccacaagtgacagccctatcaaccactacaacaagtacaagtgcttatgatgtcggtttgcaacctcaggtagcagccttccgcgcagaagtagctaatgccttcggtattacttctttctcaggttaccgtcctggtgattctggcgaccatggtaagggattggcaattgactttatggtgcctgagagctcagctctaggagatcaagtggcggcttatgcagttgcaaacttagcttctaaaaatatcaactacatcatttggaaacagcgcttctatgcgccgtatgacagtatctatggtccagcctatacatggaacctgatgccagaccgtggtagcattacagaaaaccactacgatcatgtgcatgtatcttttaattagacttacaaaaataaccgtttcagccttatctgaaacggttattgctttatatgtagtaatatagtcgaatgaattaactttcagacaaggaactgaggtgcaggtagctagaacagcctagaggctgttctaggttggaaataagacttgcgaaacaagtcactttcgtagagtacggcaagccgaaagtgacgatgtatcaaagttaattcaaatgactataaaagaagaaacaactatctccccccagatagctgtttcgtgcgcaaattacagtctaaaatatattcctaaaagaaaccttaaaccaagaacttgccttcacaagtaacctactgagctgtgaaggcgggttctaattttaggaaaattaaaattgacatgtagagtgttattttcggatgttttatcgtttatttaacttgaatcgccaatgcttggtaaggtttgagaatgatttttttgcctagtttgttgtcaggatagttgctgatgaggacttggccgtgggcatagtcgtctgccaggtctaattcgacctcttctgcaaagaaattgttgaggaccaacagtttttcgtcatttagcaagcgttcaaaggcgtagactttctggctatccttgtaggctgccttgtagtccccttctgaaatcagagggagttctttccgcaggcggatgagttcttggtagaaggtaaagattgggcctgttttttcctgttcaacgttaatcgtttggtaggatttgccagctttcaaccaaggagtgcctgttgagaagcctgcattgtcagaagcgtcccattgcatcggggtgcgggaattgtcacgggacttggcctggataatcttgaaggcctgcttaggcgtgtgaccttggtccaagagcatctggtaggcattgatagactccacgtccacgtagtcgtccatgctatcgtagtcagggtcgatcataccgatctcctcacccatgtagatgtaaggtgtgccgcgtgataggtggatagaggctgccaacatggttgctccttccttgcggaaattctccacatcaacaaagcggtttagggcacgaggttggtcgtggttgttgtagaaaagggcgttccagccatttccgacggacatttcttcaccccaagtgtggaagaggtgtttgagttcttcaaagtcaaagtccatgatggtccatttttgcccgtccttgtaatccactttcaagtggtggaagttgaaggccatggacaattctttccgttcaggagctgtgtagaggatacagttttcaatggtggtggcagacatttccccaacggtcatgaagcccttttcactaccaaaagtagcattgttcatcatcttgaggtaatcgtgggtaatcgggcggtcggtgtaagctggcttgccgtcattaattgggcaatcttctaggacttcgtccttaccaatcaggttaataacgtcgaagcggaagcctttgacacccttgtctttccagaagttgaccaccttgaagagttcttcacggatatgaggatttcgccagttgaggtcggcttgggtcacgtcaaagaggtggaggtagtatttcccagtatctccaaaaggagcccaggcattgccaccaaacttggacacccagtcagttggctggtcacgcaggataaagaaatcttggtaatatttgtcgccggcaagggctttttggaaccattcgtggtcggttgagcagtgattgaggaccatgtctagcatgaattcgatgcctagttctttgccgacagtcaccatttcttcaaagtcagccatggtgccaaaatcaggattgacagctgtataatcagaaatatcatagccgttgtcccgctgaggacttgggtagaagggattgagccaaatcatatcaatacctagctcttttaaatatgggagtttttcaataattcctcgtaaatcccctacaccatttccagttgtatccttgtaagattttgggtagatttgataaacaacctttcgtttgtctattgtcattttgctctctctttcttgatttttccttcttgcataagcaatgataggaggtgcaagttaccttgcgccctcctagaacattaattctttgtaactgtcagaatagcttcgccttgtgagatggcacgaggaagatttccgataacttgagtgtcaaagtcagtttggttggtcacgataactggtgtttcagcgatgagaccagcagccttgatgacatcgatgtcaaagctaatcaatttatcaccagcttttaccttgtcgccttgtttgacgtgagctgtgaagcctttgccttccaatccaacagtatccataccaatgtgcataaggagctcaactccgtttgtagcagtgataccaacagcatggttagttgggaagaggacagatacttcaccatcgactggagcaaccaagataccttcgctcgggtcaataaggacaccttggcccatgacacctgatgcaaatacaggatcagtagcttgtgacaattctttggtttgaccagtaagtgggctaatcaattcgatagcagcgccagtttcaacaactgcttcagttggagctacaacttcttcaacagtttcttctttttttgaaaatgcacctgtacgtttgaaaacagctgtcaaaatcattgggacaacaatcgcaacaaccattgtcataaagaatgcaccccagtattcagccttgatagacaagatacctggaagaccaccgataccgatagaagctgcttggatgttgaaggttacagagagtaagcctgcgatacttgaaccaatcatagcagctacaaatgggtaaatgtattttacgttgacaccaaagagggctggttcagtaacaccaaggtaagcagaaattgttgcaggaagagaaacttgtgcctctttttcatttttacggttcatgaggaagtaagcaaatactgcagaaccttgtgcaatgttagaaagggcgatcattggccagagaccagtaccaccagcatccgcaatcaattgggtatcgatggcgttggtcatgtggtgaagaccagtgataacgaatggcgcataaagggcaccgaatacagcaccgaagagccatttcaatgggccagtcaaaccagctaatacaactgttgacaaccattgcccgattgtccaaccgataggaccaaggacagtgtgagccaagatgattgcaggaagaagtgataggaatggtacgaagatcattgagaccacttctggaacaaccttacgccagaagatttctaggtaagacagtgccaaaccggcaaggagggcagggataacttgcgcttgataaccgatacgggcaatactaaatgcaccgaagttccaagaccagtcgctggcaatggttgctgcatctgtaccaggtacagcataagcgttgagcaactgaggagaaaccaaacagataccaaggacgataccaaggatttgtgaagttcccattttacgagatacggaccaagtgatacctactggcaagaagtggaagatggcttcacctggcaaccagaggaagtgattgacaccattccagaaaggagaaacctgaacgatggtgttccatacagggttaccatcagcatcgaagaccaactgcccatctttcatagcttgtccaagccattccatctgaacaccttccaagacgttacggaaaccgagaatcaaaccgccgacgataagggcaggaatgatcggtgtgaagatttccgccagcatggtcatgacacgttggatggcattttggttacttttagcggctgactttgcagcttcttttgatacgccttcgataccagacacagctgtaaagtcattgtagaagattggtacatcgttaccgatgatgacttggaattgaccagcgttggtaaatgttccttttactgctggaatgtcttcgatgacttttacgtttgcttttttctcatctgcaagaacaaagcgcatgcgcgttgcacagtgtgttactgcattgacattctcttttccgccaatagcttctaggagctgtttggcttctttttcaaattttcccatatatttttccttctagacggcttatggaatccgtcaccctatattttttagacatctctcgaagcatgtccttttttgaaatttgtacggacaaatttcttttgtgttatcattgtatccgatttcaaaaaataatgcaagcgtttttgcttagttttttttaattttgaaatgaattttgttataatgttgatagttgtatgttatttgacagatggatttgcgaggaaatgatgaaaaaataccaagaaatttataatgacttaaaagaaaaaatacggacaaatgtttatccggcagaaagctccctaccgacagaacagcagcttcaggaaatctatggtgttagtcgtgatacggttcgtaaggcgttggcgattttgactgagggaggtttgattcaaaaagtgcaagggcgtggttcaatggtccttaagcaagaaattctcaatttcccagtttcaggtttaacttcctatcaggaattgacaaatgttctccagctttctaccaagacagatgttgtcagcttagatatgattaccgttaatagtagcctttcgcacttgacaggctttgagccgtatagcaaggtgtggaaagttgtccgtacacgttcgattgacggtaaggtctccgttgtggatacagattatcttgctgtcgatgtcgtgccagagttgacaactgctattgctgaaaaatccatctacgaatacctagaaaataagttaggccttgatattgcttatgcacaaaaagagattacggtagagccgaccaatcgagaagagcgtgagctaatgcaatcgaaggatgattatttggtcttgattaaatctcgtgtctatctcggtgatacccaacaattccaatatacagaaagcaagcataaaattgataaattccgctttgtagattttgctcgtagaaagcattctttataggagagattagccaaatcaagttttttacgctataatagatagaagaagaggtaagatatggcaaacttaaatcgatataaatttacatttggcgagaagcaattaactttgacaactgagcatgataatttattcatggaagagattgagcgtattgcacaggaaaaataccaagccatcaaagaaaagatgccgacggcggaccctgaaaccctcgcgcttttgttggcaatcaatgctctatccgttcaactaacgcgcgagatggcatttgaacaaaaggaacaagaacttgcaagcgtcaaagaaaaggttttgaaaaagaatgtgaccttgattgacttagatgagcttgaggacaaggtatgatttcattagcaattattctcattttggcatggagtttctacattggctacagtcgtggtctagttctacaggccttctatagcatgggaagtattattgccctggtggttgcgacggctacttataaaaaattggcatccttcctttatctctgggtgccatttgccaatgctactcaggggagctccaactactattttgatgagaaatatctctttgacctagatatggtattttatgcgggattggcctttcttttgatatacgtcttggtttacgctattgtgcgtttcataggaatatttgtccatctattagaggcttttaatcctgatacaaaaacgaccaatctcataagcggcgccttggctgtcttggtgacttttatttctcttcagattgtcatggtcttgctatcaactattccgttagcgatgattcaagataaattgcacagtagttttcttgccaacatcatgattcagtacacaccattcactagtagctttttaaaatctctctggttgagtaatatagcagggtaagggaggccttatcctttttatcgtcatttataatactcttcgaaaatcaaaaccagacgttgttgatttgatgagtgggaaagactatatttttatcttttattgttttgataatgagataaagctaaggaaaagactaagtaggaatatatgaataataaaattattgaaacccttgaatttcacaaggtaagacaaaaaattgagccctatctcttgacggaacagggctttgaagaattacgacagttggagcccatggtggaagtccatcgtatccaacaggccttcgacgagttgacagacatagcgcagatttttgtggaaaatccctatttcagtctggctgctactagtgacatcggtccagccatgcgtcgtttggaattggatacagacctcaatatcgctgaattattagctgttaaaaaggtcttggaagtttctaaatctctcttggatttttatggaaatctggaaaatgtcagtcttagccagttggataaactctttgagaagattgagctttttccacatttacagggctccctccagtccatcaatgatgctggttttgtagaggattttgcctcagaaaagctggctcgtattcgaagaaaaatccgtgaagctgaagatcaagttcgtcaggtcatgcaggatattttgaagaccaagggcgacatgctgtccgatagcattttggcaagccgtaatggacgcaatgtccttcctgttaaaaatacctatcgcaataagattgcaggggttgtccatgacatttcagcttcgggttcgaccgtttatattgagccgcgggcagtggtgaccttgaacgaagaaatcagtcacctacgtgcagaagaacgccatgagctcaaccgtatcttgcaggaattgtcggatatgctccgtccgcatggtggcgtgattcgtaacaatgcctggcttatcggacatattgatttcgtccgtgctaagcatctctttgcgcgtgatcatcaagcagttgtacccaaactatctgagaagcaggatattgcccttctcaacgttcggcatccgctcattgctaagcctgtaccaaatgacctttatttcggtagtcagttgacggctatcgtgataacaggtcccaacacaggtggtaagaccatcatgcttaagaccttgggattgacccatctgatggcccagtctggtttgcctatcttggctgataagggcagtcgggtagctatcttcaaagaaatttttgcggatattggggatgaacagtcgattgagcagagtttatcaaccttctccagtcacatgacccacacggtggaaattttaagagcagctgatcaagattctctcattctctttgacgagttgggagctgggacagatccgcaggagggtgcgtctttggctatggctattttggatgaccttcgtctgcgggggatcaagaccatggcgaccacccactaccctgagcttaaggcctacgggatagaaacctctggtattgaaaatgccagcatggagtttgatagcaatagcctgcgtccgacctataagtttatgcagggtgttcctggtcgctccaatgcctttgaaattgcccgccgtcttggtctatctgatattattatccagtcagcccaatcttggacggatacagatagcgatgtgaaccgcattatcgagaaattggaaagtcagacggttgaaagtcgtcaacgtctggataagattcgtgatgtggagcaagaaaattacaagatgaaccgagccctccgcaagctctatgacgagctcaatcgtgagcgggaaaatgagctcaacaaggcacgcttggaagccaaggaaattgtagatatggcattggcagaaagcgaggatattctcaaaaatctccatgctgcagctagtcttaagccccatcagattatcgaagccaaggcagagctgaaaaagttggcgcctgaagtggtggatctgtctaaaaacaaggttctgaagaaagctaaaattaagagggaagccaaggtgggcgatgacattatcgttacagcttatggacaacgcgggaccttgaccaatcagctcaaggacgggcgttgggaagctcaggttggcttgattaagatgaccttggctaaagatgagtttgagttagtcaaggcggaaaaggcagagcagcctaagaaacgccaggttcacacagtcaaacgtgccaatgtacgaggaccaaaagcccgcttagatctccgtggcaaacgttacgaagaggctatgatggagctggatgaatttatcgaccaggcccttctcaataacctagcccaagtcgatattgtccacggtattggtactggagtcatccgagaaggggtgaccaagtacctacgccgcaacaagcagatcaaggagttcggctatgccccacaaaatgcaggtggatcaggctgtactattgtgacgtttaaatagcaatcaaccgatgggagattcttatgattatcagaaaatatcaaaccagtgatgaaaaaggctgggtttactgtaaggcactcagctacctcttctctccattctttgatgatagagaaacagagaagcccgaactaatgacagacgtttatgatcatcgtgtggaatgggtggctgaagtagatggacaaattgttggtctaatcgacatcgatatttacactgaggagtgcagccagtcttatatttacgcaccaagtaagcgaacagcttattttactaacctagcagtccaccctgattttcaagggcagggcattgcccaggcgctttttgaaaaagcagagcaggagttgagagcgcaaggtgtagagaaactagccatctttactcgtgaggatgatgcagccaaccatttatatcagaaatggggtggtgaggtagtctgttcggattatctagtggtcggagcgccacaagatgttccaaccttccgctttggaattgatttagagcgaggtagattgtccttttcagatatggaaggtcagccagttccctactatttgagagaaggtgtttatgtagtcagcgaagaagctggcttggatctctttgacatagaagatgtctatcaagaattaacctatgtggtggatttaacagaaaaaagttgaaacattttcaacttttttctttttgtaaatgaatctggtacgtgattcccccctcgtcctcctgcggtctagtttagctatacctattttttacaactgaaattcttataggtacgtttatctcatgcttcatcccgtagcaaaaattcgctttctgtttttttttggtgtagaatgatagtagaaaaacagaaacggagaaaattatggttcaagttattacagatgcaaactttgaagttgaaacacaagaaggcgtagtccttgttgacttttgggcaccatggtgtggtccttgtcgtatgcaagcaccaattttggagcaattggcagatgaagtggacgaagatgaattgcgtatttacaagatggatgttgatgagaatccaaacacagctcgtcagtttggtatcatgtctatcccaactcttttgttcaaaaaagatggacaggttgtgaaacaagttgctggtgtccacacgaaagatcaaatcaaagctatcttggcagagattggttaattgaaaatgaaagcaagtggtggatcgactacttgctttttttataatcagacttacttttgtgattattttctaatatagtcttttagtatttgctccaactatctgggagatagtgggaggttggaaatatagaaacgatatttcctagctcgtcgaagtaataaaagaaaaactaaatgacgatatttgctaagatataagattgtgaaggttggcacaagatgttataataaccttatcattgtcattttagaaaggttagatatgtcaactattagttacaaaccattaaatctctatcgtcagtttaaaacagcggctcaagagtttccaaatgttgccatttattttgacaaaccctacgcatctttccctgaattaggattggaaaatacctatcaaacagtttttgaagctattcaaaaaagagctgcccaatttgcagcagcaggtattggctatggggacaaggtaattctatataagagtccagcctttgatacctatttgttagcagtagcggtaacggcattgggtgctgttcctgttatgatttcctaccatttgccatcttcgaatttagatgtgtttgcggagcgattggaaaagtctttcattgtctacgaccaagaaacagaagaacgtgtagcaggaatgactcgaactgacctggtcacaaagatatttttaccccaagtcctagtgcaagaagcagttgcttttgaagaaaatctcctgccagaagatgtcattcaatacatgactcatacttcagggacgacaggtgttccaaaactaatctgccatacagcacagaccatgggctggcgagtagcttggcaacaaactatttttgacaagatgacggagagaggcttgctggccttccatatctcccctgtacattcacgctataatatcggcgtgtcgtcggcgattgggttaggattccccctctacccactttcttctgcaagaaaagatgatgttgaacgggcacttgctcttcatcgtccaagtgctctggaaacccatcctaataactttgtccaatgggcaagattggccaaggaaaaaccagaggtctttagtagcattcgttattaccattcaacctttgatgctatcaatattggtacgcttcgcgccttcttggaggcttctaaagagcaagatccagtctttatgcaggtttatggtcaaagtgaatgtggtccaatgattttacgttaccatcgcttggaaaacctaggaacagttagcggacgagatatggggattggtctggaaggttacacagaagcacgtatcacagatgcccaagggaatcctctcccagctggagaaaacgggcatatccagttcctgtcaaaaggccgtgctgtgacttactacaaagaagatgcccgcttccaagataatgtgtacggtgcttggtgggatagtggtgactacggctgcatgactccagagggcacgcttcttctaaaagaccgtcaggttgacctcattgagcacatcgacagcaaccttgccttggaagacttattgttggataaattggactttttatcagaagtcgtgattatccgcgatgtcaatggtgcaccgcagccgattgtcgctctggcagaagatgctgagatgaactgggaagcttggtgggccatggttgcagacctaccactattgaaagagcccatcttgatggcttatgacgacattccacgtactgcgactatgaaggttcaacgcctcaaaatggaagcagaaatgaaagaaaaaaatctgtaagagtgacgaaaccacgcttgcagataagaaggagttcacatgaaagaaatttatctagcaggcggttgtttctggggaatggaaggctacttttcccagatcgatggtattcttgacaccagcgttggctatgccaatggacaggtggagacgaccaattatcaactcctcaaacaaacagaccacgcagagacgctctatctagcctatgatgagactcgtatcaatttgcgggaaattctcctctactatttccgcgtcattgatcctttctctgtcaatcagcagggacctgacaagggtcgccagtatcggactggtatctattacacagatgaggctgatttgccgaccatcgagcaggtcatgacggagcagtcccagctctttggtggacgccccctagctgttgaagtggagccactcgcacattacattcccgccgaagactaccatcaggattatttgaagaaaaatccccaagggtactgccatatcgatcttgggcaggcaaaaatccctctgattgatgttgcggactaccaaaagccagaccagcaagtcttaaaagacagcttgaccgacctccagtatcaagtcactcaagaagctgcgacggaaagacccttcgaaaatgagttttggaatagtgaacaagctggcatctacgtcgatattacgactggcgagccactctttctctcgacggacaaattcgactcaggctgcggctggccctcctttaccaaaccaatcagcaaagaagttgcgacttatttccaagataagtcccacggcatgaaccgtatcgaagtccgtagtcgggctggtcatgctcatttaggtcatgtctttgatgacggaccgcgtgataaaggtggtctccgttactgtatcaactcagcagcccttcgtttcataccgagagaggaaatggaagaagcaggatatggcctgtttttggatttgcttaaataaatttatgaacgcagaaagtctattcgcaaagaataggctttttgtgtattaaaattgtatgtttaaaaagatgattttgatataataatctatatagagattttatttaagatgtaaatgtacagaaaggttatgaaaatgattcttagtaaacgttttaaaaatagaagaaaggaacttggctttactcaaaaggagcttgcagagggaatttgtgagcagagtttgattagtcgagttgaaaaattaggagttgctcctacatcggatatattatttgccttatcacaacgcttacaggtgtctatggactatttttttgatgaaagtgtatcagataaagcgcctgatattacggtatttaaacgattggtggacaaagctctgttcactcgttcctatgatcaactggcttatcttgtagaggcagagaagcagaaagaagctgttcattcgcaggaaagcagtgaatatttaacttatctggcttgtatagtggactttcatcattatcataaggaggatattgcaattggatgtatggaagaacttagtcatcgaatcagtaagaaatctagtttttatctggatgtatacaacagcttggttaatttttatgccttggcttctcgagatgaggatttagatggtttgtatgaggggatttcagaaaagcttagccacttggatatatcaaacacagagtgttttcataagtatatcaagattcgctacaatcacgctcactatctttttaaaaggaagaggcagtcacaggcaattgatgaattgacagacctaattgaaacattgcgagataagaagagttgttattttttggcagatatgctttgtttaatcgcaaatgtcggagagggatttctatcaaaagatgaaattctctcctactatagagaagcagaatgtctattcaaattttttggtccgcaaaatagttatctcagtttaaaagaatatctatcaaaggttatttaataatcaagtatagattcttttataaaaataattaaaatggattgaaaatcgactgttaatatgttaagataaaataaaaaagctatatcaacgaacgtttgaaaacatgttgattttggttacgggttctaatgatagggaggtggtggagtccacctcctttttgtgcaaatggggttcgttatgaaaaaagtatttacttatttatctacttttagcgtctgtctcttctgtatatggttagtgagtctgcaactcgattctttaatttatcattactatccatcggtttccatattaagtcgaggggaagaagtgacctatgaagaagtgtcggatgccctgacaaatttagctgaaaaggaaaatagtctaattgctaagacaataacagaaacagatgatagtgggcgaactactaccagttatgatgtttttgggaagggggagcttccacagggcttggtcaaagcggataggttagtagctagtcaggccaacttagctgaaaattactatgttgtaaaaggtaatctggacatcaaagtggtagaaaacgtcttacagtcactgggattggtggatagctatatttatagaccgaccctattaaacagtttaagtctatttcttggtaggggagctccgagcttaggccttattatctttatactcaccaatcttgcattgacagtagttgggcagattgtctacttgcggtcggcaggtatagagatgctttcaggggtgaggagttggcagattgctagtcgttttttaagagtggatggaagagatatagcattggctacaggaggagcgcttgtttttggattaattgctattttaattttgggttggccaatggtatattatcgttttgtagcaatcggtatcgccttttatgcttgtttgctttttttcctatctttatcgacaagtattggattcatgattgcattaaacatttctcagttacaaaagctaattaagggagctttgcctctcaaggcgatttttgctattttactagtaggtcagtgtttagcggtttgcatcatctctattggtgctagtcgaacgttgacatatgttggagttctccatacactaacgataggagaaaaggcttggcaagaaagacaagatgtttttagtctgtctttgaatcgtgaagcattcatagctgatgaagcgatggcccagcaacaaagaatggcttggtctcatgtaattttagaatcatatgcgaaaaataatgtaatgttagtccagcaccatttacggcataacacaataaaagaacataccatcattgaatccagcaaggaaattcctctagaaagggtgctgtatgtgacgccgaattatatacaatcagaaggtggactgtacgatttcaatcagctggaagagataaagcaattaggtaaaggagaaattgcattattattaccaaagagtttgcaaaatgatgcgagtgtttaccaagcgtattttgaggacatggtaggaaaattgcttgcggatggagaaggatccataagtttgcattcaaatgtttattacatttccgatgagaagcgatggttcatttacaatcataccccgataaattatgagcaatttttacaggctccgttgattgttgttctatcacctgaaagttttgaagaaacgtcctatttttgggaaaatgcgttaccagattttgtatttttcaaagataaagagatgctggaacaactgttggacaaatacaatttacaaaacacaataggtagcttgttatctagcaagcaacattacaacaccctgagaaaaaatgttcaacttgaaattcttatgaccctatctccgacaatccttggaatattcacttccatactattgttcaatacgatgaatcttctatactttgagaccttcaaaagagaaatagccatcaagcggatagcagggatgggttttatcgaattgcatggttcttatctaggagaacaagtcggctccgctcttattgggatgggtttggcaatgtttatgacaaagtcagttattgttagcctaggagtagttgtggctttgttgataaatagttggatgttactgaacaatcaagcgaaaagggaagaaaaaatccagttgagtgtattaaatggcagatagttaatgaggtgaagttagaatgaaaggaaaatttgtacttgtatcgacgatcattctagccgtctttatgatttggttgggcgtcagtcaaaaggagactatgctagttcattattatccttctgtgactactttgtcggtatctgaggacgtgacatattcagatgtacgacagcgattagaagactattctcaacagacggatagtgtcattgccagacgagtgattgagccaagtaaatcaggtggacgtaccttttcttatgataattttagtcaatctcccctaccaagaggactagaggaatttcaggcatcagaaaaggtggagtctgcacttttaaccaaatattttattttccaagggaaagcgacggtagaggagcttcggtctcttcttgtttcgcttggacttgatgaagttcagattcggaagccttcgactattgctactttactcgtatttctgacccaaggtggtcaattcttagccgtactggtctttcttattacgtatatggctttggtcgtgattgctaatgtaaggcagttgcgtacagcaggtatccgtttgattgcaggggattcgcgctggcatttatttctactatctctacaggaaaatgcgaaagagatagctctaactatcccatttgcggttcttccagcagttggactggcctacctcgttggattagatggctattctgtctactatctggtcgcagctctagtgggctatcatttcttgcttggtttgattgtcctttttttcgctgctacatttaccttggccattcgaacctatcactttttacccttgttaaaagggaagatgcccctgcaagggatcctgaccattatggttatgggacaaatgctggctctattggtggtgtcatttgggatggctcaaaccgtctattattcagggatttggcaggaatatcaagcaggtgcccagcagtgggagaatgaaggggattactatagtttagcttggaatatttctgcggatggtcgctcaggactaaattcgcctgaaaattggtatcctttactaaggcaagctttggaggaagacggcgcactctttgtcaaaagtaatttgaatgcctatttaatgggcttccaactggaagatggaacacgccttgacagctaccatccagctggaaacaccctctacgttagtccaaattatttgcagatacaggatgtagacttagcagaaggagaagtagcgctccctttacaagaaggagaatttcaacttctgttgcctgaaaaattgcgccctgaaagcgatgcttatctccatctttaccaagattatatcaatcgtatggttagacctgctaatcaagcacgctcagctaccattaagggaaaagttgcctatttaaaaaatgggcagaagcagtttatctacaatcatcgttctggtcaacatgtgcaatacctgacagaccctattttagttgtgctggcaccgtcaagtctgggaaaagaatctgctgacttttggttgaatgaagtagatagcagtatgctatttaaaaacagagataaacttttacgtgaattgaaggcaagaaatttgtttcagtttgtcaatgaagtgagaagtagttcttccctctttacggaacttttagatcgtattcggatagagaccatttcaacatctatgggtgccattttagggattgtgacatcaattgtcctgtttaataccatgaatcttctatactttgaagaatttaaacgtgagattgtcatcaaggaaattgcagggatgggtttcttgggaatccataagaaatacctaacgcttcaactgctttctctcttgttggctcttggagcaagtatggtagtaacaggtcacatttttataagtagcatcagttttgccttgtttatggtcaatgccctctgtttattgaggtggcaggcgaggaaagaaggagcttggaatgtccgtattttgaaaggagcctagtatgttttctgtccaatcaattcaaaagaaatttgggaagcgcagcttgttttctgatgtaacactagacttgcaggctggaaaggtctatgccttgataggtgccagtggtagcggaaaaacgaccttgctgaatattttagccaagttggagtcctatgatgcaggtgacattctctacaagggaaaggatttgaaaaagttgaagccccatctcttttttagggaggaattaggctatctctttcagaattttggtcttttagaaagtcagacaatcaaagaaaatctggatttgggactgattagtcagaaattgtccaaagacgaaaggaaatcgaggcaggaagcggcacttgatgcagttggtctgtcttatctggacctgtcccagcctatctatgaactctcaggaggggaagcccagcgggtagctcttgctaaagtcatcctgaaaaatcctccattgattttagcagatgagccgacggctgccttggatcctaagagctcccaagaaattatggatattttgttatccttgaagagcccagatcggttaattgtgattgcgacccataatcctttgatttgggagcgagcagaccttatcataaaaatggaagacttgtaaaaattcatactcttcgaaaatcaaaattatccgttgtcaacttaccttgatgaactccagttctatcttcggcttcgtttcctaggctacttttgattttcattgagtatcagaaaatattcttgattttttcgtgaaattagattaaaataaaactagataaaactgaataaccggttgatattgggtagaagggaaactgactgttcaatggacggaactctggagagaccattttggcaccgaaggggcaaggtagtcctgcttggaaaagtagagctactgaaactctcaggtaaaaggacagagcgttgaaaaataggctttttctgtatttttcacgttgattctagaggttgaagtgttcagcctctttttgtttttccggcagctttatcgggttagaaacgcttaggaggaactatgttagaactatttaaggctatcaacaatcttgtttggggaccgcccctcttgttactattggtcggaacgggtgtctattttaccctacggttgggagtatttcagattggcaaattgccgacggcttttcgtctgattttctccagtgaccagtctggtcagggagatgtgtccagttttgcggctctgtgtacggctttagcagcgacagttggtacaggaaatatcgtcggagttgcgacagctattactacaggtggtcctggggctcttttctggatgtgggttgcggcctttttcggaatggcaaccaagtatgcggaaggatttttagcgattaaataccgaaccaaggatgccaacggtcaagcggcaggtggacctatgcattatatcaccttggggatgggacagaagtggaaacccttggcagttttctttgctatttcaggtgtattagtagctctcttggggattggaactttttcgcaagttaattccatcactgcttctttggaaacgagttttggattggaaccgccacttgtcagtgtaataacggctatttcaattgccttcgttgtttttggtgggattgaaaaaatctctgacgtttcgaccaaaattgttcctttcatggcgattttgtatatcttagcaagtattactgtcttggccgtgcattgggatcaactcttgccaaccctggccttagttttcaaatctgcctttactccagcagcggctgtgggcggttttgcaggtgcgactgtgcaacaagcaattcagcgtgggattgcgcgtggggttttctcaaatgaatctggtttgggttcggcgcctattgctgctgcggctgccaagtctgataatccagttgaacagggcttgatttctatgacgggtacctttattgatacacttatcatctgtaccttaacgggttttacgattctagtaactgaccagtggtcggtagagggcttggcaggtgctcctcttactcaggcagcttttgcaacagtttttggcaatacaggatctattgccttgacgattagtttggtactttttgcttttacaactattctcggatggtcttactatggtgaacgctgtatcgaattcctctttggcaccaagtctatcttgccttaccgtctggtctttgtagctatggttgccttgggtggtttcctcaaactagacttgatttggaccatcgcagatattgtgaacgggctcatggcactaccaaacttgatcgccttactagctctctctcctgttatcatcaaggagacacgccagtattttgcaaagaagaaataagataaaagtcagccacttggctgtctttttgttcttttagggtgttttctgctataattatctcatgaatgattttattaccaagtatttgtctcaatttaatattgaggccattgtgacagcaggtctaaataaggttttatcgcttgttttactctttgttgcattttacattatcaagaagatagccaaagcttctgtgaaaaaggttttggttccctctctaaaggtatctacccaagacattggtcgtcagaagaccatcagtcgtctggtggaaagcatcctaaattacctactctactttatccttatctactgtattttgagtatcctcggtttaccggtatccagtcttcttgcaggagccgggattgctggggtagctgttgggctgggcgcacaaggttttctctcagacttggtcaatggattctttatcttaattgaacgacagtttgacgtcggagatgtggttaagttaaccaacgggcccattaccatttcaggaaccatcgttagcatgggaatccgaacaacacaagtacgtgatgcagatgggacattgcattttattcccaatcgcaatattctagtggtgtccaatcagtcaagaggggacatgcgtgctcaaatcgatattccgctcaaatttaataccgatttggaacaagtctatcgcgtaatagaagaggtcaatttgagagaaatcagcaattttgaccagattacaggtgtgactgtattaggtccccaaaacgctatttcgggacagtttgtatttcgtgttaatcttttcgtagccaacggtcaacagaacaagatctatcatcaattctttggtttttatcaagatgctctgcgtcaagcaggaatagatttaccttcaagtgggccaactgttttaaaataaggagtttattatgcaaacaaaagattttgtcgttgaaaatgggcagatgtattataagaagaaacccttgcacaaacagcctctcttttggacgaccattgctggtgccgtcctctccttcatcctaggagtaacctgttttatttttatgatcggcctaagctcagcaaattttgataattgggatacaggtagtgacggatacattgatgagactgtggaatacacagagtatcaagttggtgactcagttgatttttctaacggtcttcatgtaacagtaacatctatgggcaaagacgatagcatagaactagtggatagctactacagcacagcttatgttgttgaaatggaagttgaaaattcgaccgcaaaagagctctattttgatgaatactatttcagtctcatggatcccgttagtcagattccctttaccctggatttgcggacctatgatgtgaatctagttgaaaagttgaagccaggagagaaagtacaagtaaaacttatctacggtatagataatgaaacaaactttggttttacctacgaagatgccatgtggacggaattagtcgcagaaggtatctaattgctgtagaaaaagttttaaatattgcacaattttgcggttttataacgccccttggttcagattgttcggcttggtaattgtactatatccgacttatctgttatttttacatttaaaaaaggagaatatgtttatccactgttctcctcttcttttaatgaaaaatacccccaaaattagcacgtcaattttgggggcgtttttattatagtttagtaaactaaaagtaagcttataccaaaccttgggcaatcatgctatccgcaatttgttcaaaggctgcgatgttagcacctgcaaggtagtctgtaccaaggtcgtatttttcagcagtttctttggctgtgttgaagatgttggccatgatgtctttaagacggccgtctacttcttcacgagtccatgacaagcgaaggctgttttgactcatttcaagggcagatacagctacaccaccagcgttggcagcttttgcgagtccgtagagaacgccattttccttgtagactttgatggcatcaaggtcagatggcatgttggcaccttcagccacacagtacacgccattttttacaagggcagcagcttgtttgccgttgatctcattttgagtcgcacatggaagggcaatatcagccttgccatcgtagttccatacagaacctttgaagtacttagcagttgatttttctgcagcgtattctgtcaaacgagcgcggcgtttttctttgatgtccaccaagaggtcgaagtcgataccagtttcgtcaatgatgtaaccatttgagtctgaaacagaaataacttttgcaccaagttcagtcgctttttgaacagcatattgggcaacgttaccagaacctgagataaggacagtttggtctttgaaggatttaccgtttgctgccaacatgttatcagtgaagtaaaccaaaccgtaaccagttgcttctgggcggatcaatgaaccaccgaagccaagaggtttaccagtcaagacacctgcatcaaactggcggaggcgtttgtattgaccgtacatgtaaccgatctcacgaccaccgacaccgatgtcaccagcagggacgtcaagtgaaggtccgatgtgtttttgcaattcagtcatgaagctttggcagaagcgcatgatttcagcatcagtttttcctttaggatcaaagtctgaaccacctttaccaccgccgattggaagaccagtcaagacgtttttgaagatttgctcaaaaccgaggaacttcaagatggattggtttacagttgggtggaagcgaagaccgcctttataaggacctacagctgagttgaactgaacacggtagccacggttgacttgaacatttccatctttatctgtccatggaacacggaagctgatgatacgctcaggctcaacgatacgagccaagatgttttcttcgatgtattctgggtgtgcttcaaaaacaggctcaagtgtagagaagagctcttctacagcttggaggaattctgtttcatgtgggttgcgggctttgactgcttcaaaagaagcttggatgtaagctttggcatttgacatgggatcacctgatttcttttttatttattaaattgtctgacaatttaatttatctgataattattatagcaccatgatttttaaatgtaaagaagaaaatgtaagaatttaaaaaaattaataaatttttattgcaaaatccgaatgttagtagtaaatgaagaaaatccgtttgtttcttatgatataatcaagaaagaatgacctatatggaggataagatggtttcaacagtaacgacactcggtggatttacctttgataattgtttgatgaatgcagcaggggtttggtgcatgaccaaggaagaattggatgcggttaagaactcgaaggcggggacttttgtaacaaaaacagcaaccttggactatcgcgcgggtaatccagaaccacgttatcagaatgttccgcttggttctatcaattcgatgggcttgccaaatcagggcttggcttactatttggattatctactagaattgcaggaaacggagccagaacgcacatttgttttatctgtagttggaatgtcgcctgatgagactcatgaaattttgagaactgtagaagccagtgattttaaggggctgacagagttaaatctttcttgtcccaatgtccctggaaaaccgcagattgcctatgattttgaaacgacagaaaccatcttgcaggaggtcttcacttactttaccaaaccactcggtattaagttaccaccttatttcgatattgtgcattttgaccaagcagcagcgattttcaaccagtttcctttgaagtttgtcaactgtgtcaattcgattggaaatggtctttatatcaaggatgagtcagttgtcatcaagcctaaaaatggttttggtggtatcggtggagagtatatcaagccgactgctcttgccaatgtccacgctttttaccaacgcttgaaaccggagattcaaattgttgggactggtggcatcttgacaggtcgggatgccttcgaacacattctctgtggtgccagcatggttcaagttggaacaaccctgcaaaaggaaggtgtggcagcctttggacgcattacggctgaattgcaggccatcatggctgaaaaaggctacgagaccattgaagattttcgtggcaagctacagcacttagatgactgagatcatctgttgaagacataaaaagaagctaacattgtactgttctcccagatagtcttttagggagtcgcgaggggataatgttagctctttttaaatggtctgtgaagatcggtctgataatcgtttgaggaatggaatacatagtcagaaacatatatttgtgagatggaattctgattttatttagattttttagcaaaaatatcgtatactaatattagaacctctatttataagtgatgtgcttttatggaagaaatagttttttgagggactgctgactgtattttgaacaaaggttcttaagtagggagtatgagggtaaaggtatggagagaagggcgaactatattcgcagaaaacgatatgcgtcctatcggacaaagatgcatttgttttttatttgtggcttagcgactattatcttggcgattattattgtaagcgagcacctagttcctaggctgaatcaggcctcagaatcaatgcactcagataattctgttcgcatcatggctcatggggatttgctctatcacttgcctattcttcgaggagcagaacagccagatggaagttacgatttttctgagaattttacctacgtaaagccctggatagaacaggctgatttcgctatcgcagactttgaagggaccatttctccagatatcgaattagcaggttacccactttttaatgcgcctgccattgtcgccaacaatatccatgatgcaggctacgatttggtggacttagcccacaatcatatcttggactcacatctatcagggctgatttccactgtcaatacatttagagatgcaggtgtggatacagtcggtgtctacgtcgaaggcaatcgggcaactgcaccactctacattcgggaagtcaatggtatccgtatagctgtcctagcctatgcttacggtttcaatgggatggaggctttgctgagtcaggaggaatatgatgcctatttatcggattttgataaagaaaagatgcgggcagagattgagcgagctgagaaagaggcagatattaccatcgtcatgcctcagacgggtgtagaataccagttggagcctacggaggaacagaccagtttgtaccatcaaatgattgattggggagcagacatcgttcttggtgggcatccgcatgtagtcgagccgacggaaattcttgagaaagatggtcagagaaaattaatcatctattctatggggaattttctatccaatcagcgtatcgaaagtatggaagataccccaaatgcccagtggacagaaagaggtgtcttgatggaccttactattcagaaagagaatgggcaaacaagtattcaaacggctcaagcccatccaacctgggtcaatcgcctttcaaaagggacttattcaacagatggatacgaacaattttcctaccagacttacattttggaagactgggtcgctggtggtcgatactatggacaattggatctagatacacaggcgcgtgtggatacagcctatcaagaaatgaaagactttgtcaatttggtatggtgaggagagagaagatgatagttcgattaattgcaacagacatggatgggacctttttagatggtcaggggaattttgatagagagcgattttcacgggtcttggatcaactagatcagaaaaagattccttttgttatcgctagtggtaatggaattgggcgattactacaattatgccaaggatttgaagacagattaatctttgtagcggataatggagcccatgtgtatcaaaatggcaagacagtaattcgtcgggctattcagcaagtggaagtcgaagcaatactgcattttttcaaaggccgttgggcggatgtatgtctgatgttgtcgaacgatggaaatatttatatgcaggctggggcaggtatgccgtttgcaggaactgatttgccaatagaactagctcagatggctgccttccaaaatcgtgtgacatatttagacaaccttagtgcctatccagtttcagagtcaatacacaaggttggtctctgggttcctgaagcgcgtgtagaatcgataacggaagcctttaatcagggttttcacggtcagttggtggctgtaaccagtggttatggttccgttgacattctaccgcagggtatccataaggcttggggcttggaacaggttttgaccggtctagatatcgaacctgaacaggtaatggccttcggtgattcagacaatgatattgagttattgtcctatgttgggtattcctatgccatggaaaatgcgacagacaaggtcaaggcggttgccaaatacatggctccaagccatttggaagctggtgtgcttcaggtcattgaagaatatatcttataagtatatagaaaaaagctagtgctctcaatccagagaatgctagctcttttaatttccaacgctggtgaacttggtcataccatagcggaagaggttataattgatggaaaataggaccactaccaccagaggcaacgccagtccccacatagacaagtctaggaagtagagagcagggaagtaggcggtaaaggcgtaggggaaaacaaaaatcagcaggatttgaatgatttttggatagatattgagtgggtattgagccatctgattgagggcgaaaattcccatagtcaaaggaaatgattccacaatccaaaatgctagagcagttggaccgagctgaatggctgcatagagtaggccgatacaaatggcaataaagattagtaaggctagttttccaagactccattccatgcctagctcatttgaagcttggactagtgcaagggaaccgatgagggttgttccgattccttgtggctggattcgttcacagataagttgaaaaagtgggttcataggcatgaggaggaggcgttcaaattcgccttgtcggatgtagcgactgccaaacatccagagattgtcaaagaatatcaggtgaatggagcgtccgacggtcgctattccatagataaaaagcatttgaccgtagttgaaaccagcgatttccttgatatttccaaagagaatattgaggaaaatcaggtagacaatttgttcaatcaaagaggagaaaagcccgatgaagaagtccacccgaaaggacatctgggccatcatgtagaccttgatgttatagagatagaggctgatatatttcttcatgttaacctccaaaaatgacaatacgacgcttggcttgggaccaaagagcagcaatgaagcaggctaggatgggtatccatataacttgcaatcccaaagcagttagatcgctttcctgtcccaataaaatggaaactggaacgttaaccgcataattatagggaaggagcttcaaaaagttttccacagcctgtggatagaagctgagtggcaaaagcgctccagaagctagattgaaaagtcccattctcagaagcatgactccccaggcattgaccgtaaaaaatgctaagaagccaaaagccatatccagtaattgaacgataaacatccctaggatggagctgactagaaagagcaaaatagtttttccgtcaggtagataaaaatcctgatgaacaagtaagatgccgataaatacgatagcaaattttatcagttccaagagcttatttccaaggtctttgaaaaagagagctaggataaaggaatagggtctgagaaattctccagcaatgcttccttttaaaatgctgtaggataaatcttctccgagtgagaaagaatttaaactggctagtagattagcaaagatgatatatgtagtaaaggtttgtagggtaaagccattgacttctgattgagtgaagaaaatggttttccagacatagagagctaccaaaatcttcactgccagtgaaacgaaggtcgctagaaagaaagccttatactgcatagcattcatcatggtcaggcgggtcatgtagagatatttacgcatggataccctcctcataaatctgacggaccatggtttcaatttccaattccttcatggtgacatcttcaattgaataatgattgaaaacttgctcaatcacctgggcgctggtccagaccttgctttggtagtggatttcaaagtgaaaatcatctttacgaataaattcccagccctccaattgcaaatctttttcaattggtttttctgtggagaagagaatggtcttgactgtggaaaagcgttctttgaggacggtcagtgaaccatcgtagaccttcttgcccttatcaatgataaaaatccgctcacagaggctctcgatgtccttcatatcatgggaagtaatcaaaaaggtggtctggtattcttgattcatatagcggatgaaggagcgaatggtctccttgacgctggcatccaagccgatggttggttcgtccaaaaaaacaacggcaggctggtggataaagatagccgcaaattcacagcgaactcgttggccgagtgacagattacggattggttgcttcataatatcagccaagtccaatagctcaatcaagacagccaatcgctctttgaataccttatctggaacatcataaatttttgcgtgaaggataaaagattcttggacaggtaagttccaatccaagtgagatttttgtccaaagagaacgccgatttgcttattgacagctttgcggttttcttgtggattgagtccgttgatacgaacctgtccttggtctgggaagaggactccagtaagcattttgatggtggtggatttaccagaaccgttggagccgatatagccgatgatttttccttttcctacctgtaaggaaatgtcttgaacagcagggattgactttttctttggcttgaaaaaggccttgatagagccttttagaccgacttccttatcaatgattgaataggtttttgaaagatgttctgcctgaatcatatcataatctcctatttgaaaacgtttgcgtaagataaggatattataacatattccccagaaagtggcggtaaaaagtcgcctttaaggtaacatttttattagaaaatcggtcatatattgaggagattcttgcttaccatttttaatccatacctgcatgataccgaagaaggcatgtgaaaaatagatgctgctgtattctttttccagttgtgataaattctcttttcctaagcgctccgctaaatcattggcaacaagaagtcggactttattgataagaaaattttggatttcttgagttccgttatgggtcagtagggcagaaagcaatttttcacgatagagcaactcgaaaatttctaaaaatgatgattggcgattgccatcataatggtcaaatatagcctctaatttgtgaaaaagtccctgttgataggagtcgattaattcatatttatccttataatgggtataaaaactggaacgactgataccagcagtctgggctaggtgtgttgttgtaatgtcattaaatccttgtgattccaggcaggttaccatggcttctaaaattgcctgtcgagttcgttctttccgactatctgttctcataatttctccttttgaacatttttagacacagtgtctaaaaacagttcttctgacttgattttgaaattgatacttgtataatgtattttatcagtttttggacagtatgtctaaaggagttgcttatgttacaaaaagtaaagaatattttcaaaaaaccaatgaccttgattaccattctaggtattgcctgtgtcccagctttgtataatattagttttctaacttctatgtgggatccatacggccgactagaccagctgcctgtagcagttgtcaatcaagaccagtcggcgagctttcaagataaaaccctcacaattggtgatgatatggtggacaatatgaaagagagcaaaagtctggatttccactttgtatcagaaaagaatgcggagaaaggcttggaagaaggggactactatatggtcatcactctaccagaagatttatcagaaaaagcaaccagtctcttgacgaatcagcctgaaccgataacgatttcttatcaaacctccaaaggtcatagctttgttgcttctaagatgggcgaatcagctatggagaaattaaagacatctgtttcagagacaattaccaaaacctacacgactgccgtttttgatagtatgagagaaattcaaaccggcatgatcgaggcggcagatggtagccaaaaattaacaaatggagctagtcaattggagtcaggcagccaaacactttcaaatggactgactactttaacgacttcgggtcaagtactcgtgacaggagcaaaccaattggccaccggagttgtgtcttatacagatggagtcaatcaggctgcaacaggcagtcaaacactgtccagtggcttaacgatttacacaaatggggtagcgagtcttgtttcaggtgcggagcaattaaatgccaattcctctcagctcatcactggggtgggacaattgcaatcaggagcaagccaggttgaacaacttgtaacgggagccaatcaattgcaggcaggcttggaacaactcgctaattcaactagtttgtctgctgaacagtctagtcagatacaagcactcttgacagggcttccacagttgcaggtggctatcaatcaattaaatgacagcctatcaagtatcggaggacttgcagttgataactctactctatctagcctcttgacggagatgggggctcaggctcaaggcttgttgacagcagcccaagctgataaaacagccagcatcgaagccttgcaaaccacggctacctatcaaaacttgacagctgatcagcaagctgaattggttggtgccctccaaaattcaccttcggcaacagcgacagtagcccaaacgattttggatcaattgtctcagctcagtcaaaccctttctagcctacaaagtctttctggcatggcaacacaaatgaaccagctacaatcagctgtcggtcagattaacacggctgccaatcaagcattgccaggagctacaacagccattgaaagcctatcaagtggcttgagtcaggtcaacacagctttgaaccagcaagttctaccaggaactcaaaccttgacgagtggtgtgagtcaacttcaaacgcaactgtcaagcggagcgagtcaactcatgtttggagtaacagcctataccgcaggtgttgctcaattagcagcaggtggagcccagttggttgcgaataatagtagtatccaatctgggggtggccagctaacatcaggattggcaaccttggcatccaactccagtcaacttgtcagcggttcagaacaactggcttctggtagtcagcaattaattgctggtgcggatcaattagctagtggtggccaagccttgacaagcggtatttctagtcttcgtacaggtagtgagaccctaacgaattcactcagctcagccagtcaacaactatcagtcgtctctgtagaagacaaaaatgcacaagcagtttctcaaccagtcaccttggaacacagtgaccaagatgatgtgaagaccaacggtgtcggaatggctccttacatggtatcagtcgcactgatggttgcagccttatcagcgaatgttatttttgtcaaacacattgataatcgctcctacaagaatcgttgggactgggccaaaggaaaactcttgctcaatggtatcattgccagcctagcagcagtgattctgtacggtgttcttcgcttgattggaatcgaaccagctcatccaatggcaaccttgggaataatcctcttagcctcttggaccttcatggccctcgttacagccttggtgggctggaacaatcgtttcggatccttcgcaagtttaattatcttgttactacagcttggatcaagcgcaggtacctatccaattgaactcagcccacgcttcttccaagtcattcagccctatcttccaatgacctattctgtttcaagtcttcgtcaaaccatttctatggttggaaatagtagtcatcaagtttggatgctaagtctcttcttagtaggctttatgggactaggtctcttgatttataatcaaaaagatgaataagaataaaaccaactgctccatgtgaacagttggtttttggttgatgtggttatttgggggtccctaaattgattgtcgcattggtggcttcaatggtcagtttgttcttgctacctttgttttctagggttagggtctgtagatcgttttcagtcttgacagggaatttggtgtacttatcgctagtgaaaataccgacttcccctagtcgctcttttaagtaagggtcttggttaaccatctctcccaaatcattcccatcttcatagtagtaaccttgggcttctactaattttttcttgtcgatctggttggtgatgagcaagttgctatctgccaggctcttgtccgtcacatccaaaaatgtcgtagaggagtaggtgtcggatggagtgaaacgattatcgccaagaagagtcgtttgtctgctatccagctggctatagccctcgatggtcacattttccaaactggtttcatacaggcggacgctgcttccctgtaggttgatgtgcatatcttttagagtggattgtgtcgcttggaagtagcctgcttcaatctgaccgctgtcaatagtcaccttgtcaagagtgacaccaccagacagatttgcctctttgatatggatattctcaatcgtgaaaccgccaaaatcatagaagtggagattgtgtccctctaatttatccagtgtcttccctttaggcacttcaatggtgacggagaagacattgatacgacgctgggccaagctttctcccagatactgcatgattccctcaatggcaaattctagttcctgtgcagagagggttaagacgccgtctttctcactgagttttagagggttttggatattgttgtcggagttggcataggtcacatgatagttgttatcactagactctttgatgtagacgctgtgggggataaaatcaattttaatggtattcaaatctgtgaaggtcttatggacttccgtcggagcagcaacctcttctaagcgggttatgcctccggtgaaaaatccaatgccagctagaattaagcctgcaatcaggctgacaaagccgataataatggcgatggtaagtttctttttcatgctcgtttacctcgtttcaaaatccatttgaagcaagccttgaccagtcgccaagaccagtaggcaaaaaatccagtcaagatgtagatgagaatagctccgccaatcaaagacaaacctgacccaaaccccatgaggaagatattgaaaccttctgacataaggctaaaggcttcccaaattagatagccaccgctggtgagaagtccgacacccaaaacaaaggcaccgacaatgagggccaagatgagcgccaccaatcccaatagactagctaggagaatgagcaaaagtggaatggcgataggcagggaaatgacagctaggatagccaaccagagcgttcgttttgtttggctaaaattacggaagtagcgaccgaggaaaaaagcgccgaggataagagtcgcaaacagaggaatgactccgataaactctcccatgataaagagtaggaagaaagagaagagacctgtcatacttaaggctcccagaccaacccagagtttccagttgagttgaataggttcttgttgatccttctcctcctggatttgcttgttgagcatgttgttaatgagttcgctggcagcttcttttggggaaccaagttcttctataatttctgtttcacgctctggtccagcctcgtcaaaatactcattaaagaagctgatggcttcaaagtattctttgtggggcagttttttgagatatttttctaactgctccatatattcagttcttgtcatggcggacgctcccttctatgatgccgtttatcgtgtttgtataggtatcccagtcatctttgagtcggaccaattcttcgtgacctaactgagttaggctataatactttcgcatacgaccctgatattcttgggaataagtagtcaaaaagtcattttgctccaatcgttttaggatgggatagagggcggactccttgatgttggcaattaatttaatggtctgacagatttcatagccataagaatcatcggattccaaaatagccatgatgagaaattctgtcagcactgcggggactggaaaatgcataggacgctcctttcctttgttgttagttaggttcggttttgatatatagtgttcggttgcatatatcaaatttttctatatattaaatatacacctacaaaaataaattgtcaagtgattatgtgcaaaataaataaaataacttaagaccaaatagcttaggacaaatttttaaggtgtaaacgttttatagccttgaaaaataatttcagagtagtaaacttaataacagtactaacattaagggattttctggactaaaagagaatgacctcagatggattagtagtatttaaggtggtgtaaagatgaaactatatgttcagtttatgattattctggtattttcatttttaggggaagctatttcgactatttttcatcttcctattccgggaagtattattggcttaatcctcctatttttagccctagagttcaaattgattcgtcttcgccatattcatacggttgggaattttttgctggctaacatgaccattctttttttgcctgcagcagtgggcattatggagagatttgatgcaattaaagattatttacttcctattatcgtcgtcattttaggcgccatttttttaaatatcttagtaattggttttgttgttcaatttgtgaagcaaaagtttgaaggcgactacattgatgcggagggaaatcatgactgaacttttttccaatcctatttttggtattatgttatcaattgcagcatatttaattggaatgctgatttatcggagatttcctcatccaatcacaaccccactgttggtagctacaggattgattattgtctttttaaaaatgacaggtatttcctataaggaatattatgcaggagggtcctatctaaatatgcttattgtgccttcaacagtagctctgggtattcctttgtatcgttctttccatctaatgaaacatcacattcgaagtattcttttgggaatttttgttgcctgtattgtcaatactgtctttactgccctaattgcaaaatggtttgggatggatttttttctagcaatctctctttttccaaaatcagtcaccactgctatggctgttggtattactgataaaatgcaaggaatagcaacagttactcttgtagtcgttgttgcaacaggaattctgacaagtgttcttggtccagtctttttaaagctactaaaaattgaagacccggtagctgttggtcttgctttgggaggaacaggacatgccattggaacgggtacagcgataaaatgtggacatacacaaggagcgatggctggcttggctattgggattacaggcatcatgtatgtggtgattagtccaatagttgcgcagattatcttacaataaaaaactacgattggaattccaaccgtagttttttagtctacataaagtttggattgattattcaaccaactataaagaagtccgataaagagaccgcctcccacgtagtttcctaatccagaaaagaggaaattgcttagtacacttaatagagtcattccctcaactggtccaccatttgcaaaaaaggccagggagaagagtgaaaagttcgcaatgacgtgctcatatcccaagaaagcaaagataaagatgatgaaaataacggaaatgagacgtccagcgtcatctttgatgcgtaagaaggtaaatacgccgatattcacgacaatattagcaaaaattccttcaataaattgagtcaaaggtgtctttgaaagcttggccaccgttgcttcaaataggtagctgtgagcatcaacgtgctgataaggcagagtcagtgagaccaagtaacaaacaaggacagcaccgacaaagttgaaaaggatacaggttgccaacatcttgagggctgttttagtaggaatcgtttttcgatggctggctactgtcatatacatcatgttggatgttccaagttcggcattcatatataaaatcatgagtagcccccaaccaaacatcaacccatagctaaatttcccgagtccttctgcgacatggttgagtttgtctgctgtataaagagaaatgacaatccccaatcctaaataaagactggctagtattgatcgtacagcgtaggcagaaaaactgtgttcaaacaaatctgcttttttcttgatactcttttcaagtgtatacattaatgtctcttggttagctcccatcctaatctccttactgaatctactactttttcgagtaaacgttttctttttatcgaatggctttactttgtttattatacttgataaaatggttgttgtccaaaaaaaattcaacttttgaaaggaaatataagaaaaatatggatgttacatggacagtgaaatatatcactgaatttttagcgactgcactccttattatcattggtaatggtacagttgcaaacgttgatttaaaaggcacaaaaggaaacaactctggttggattctcattgcgattggctatggtttggcagttatgatgccagcattgatgtttggtaacgtttctggtaaccatatcaacccagccttcacacttggtttggctgtttcaggtctcttcccttgggctcacgttgctcaatacattgttgcccaattgttaggtgcaatgtttggtcagttagtggttgtagcagtgtataaaccttacttcttgaaaactgaaaattctaaccatattcttggctcattctcaactatcagtgcgcttgataacggaacgaaagaaagccgtaaagctgcgacaactaatggtttcttgaatgagttcgttggttcatttgtattgttcttcggtgcccttgctttgaccaaacatttctttggttcagagttggttggtaaattgattgaacagggctatgataaaacagtcgctgagacaatgactgctccatatacttcaggttcaattgcagttgcccacttaggcattggtttcctagttatggctcttgttgccgctcttggtggtccaacaggtcctggtcttaacccagcgcgtgaccttggtccacgtatcgtccatgcccttcttccaaaatctgttcttggtgaaaacaaggctgattcaaaatggtggtatgcttgggttggtgtatgtgctccaattatcgcatcaattgccgctgttgcacttttcaaattcttgtatctataatatagagaacccgtttcgtcgggtttttctttttctcttggtatatcctatataaagttgtctgctctgctattttcctaaaagttatgctacaataaggatagaaaaatcggaaaagaggctagaatatgtcagatgttattgcttttggctatggaagcagtcgagcgaagatgcagctcaagcggctcaatcgtcatggaatcatcgcaggtgcgacaggtacagggaagaccgtgaccttaaaggtcttggcagagcagttgagtgatgcgggaattcccgtctttctatcggacatcaagggtgatttgaatagtttggttgcggccaataccaaggagattgatcctagtcgtctagagaagactcattatcttgactatagcccagtcggttatccagttgagttgtgggatgtcttgggggaaaatgggactcctatccgcatgactatttcagagctgggacctgtcctactgacacgtttgttgggcttgaatgatactcaggagtccatcctgaatattgttttcagcgtggcagacgagcgtggtctgctcttgattgatttgatggacttgcgggctatgttaaactttgtggctgaaaatgcggcagagctgagccagtattatggaaatattccagctcgttcggtcggtgctatcttgcgtagtctggttgttttggagcaacaaggtggtaagattttcttcggtgagccaagccttgatattgctgatttgatgcgtacggcagaagatggtcgtggtgttattaacgtccttcaagctactcagctatttaatcagccaacattatattcaacggttcttctcagcctcttatcagaactctatgaagtcttgcctgaggtgggcgatttggacaagcctaagatggtcttcttctttgacgaggctcatgttctcttcaaagatgctccaaaagttcttcttgaaaagattgaattgattgtccgtttgattcgttcaaaaggtgtaggtgtcttctttgtaacgcagaatccgacggatattcctgatagcgtggcagcccagttgggtaaccgcatccaacatggtcttcgcgcctttacaccaaaagagctcaagacagttgctactgtcgctgaaaccttccgtcaagaaggtgatgaggatttggccaaggtcattcaggagttgcaagtgggggaagctgttgtgtctacccttcaagcagatggtacaccaagctttgcggatcgggttttgatttatccaccaaagagtatgctgggaacggtggagccaagcgccctcttgtcagttatcaataattctcctttgatggaaaaatatgctgacgcggtcaatcgtgaatcagcccatgagcagattttagccatgacagaggctaaagaagccgaactcatcaaaaaagcagagcaggccgaggcggaaaaacaggcagaaaaagaagctaaggcagccgcaaaaatggaagagaaagcccagaaagaagcagctaaaactgcacaaaaaactagtcagccagccagtcgcaaaacagactctatgatggatcgttttaccaagaacctgatgagtcaggtcggacgggaagttgggcgcgtggtaactcgtggcattatgggcatgttaaaagggaaataaacgactagactgggaaggaaacttctcagttttttatctagacaaagttcttgccagatgccacaaaattcgttaaaataaacacaaatcactagttagtaaggagttgccatgactgatcaattgcaggcattattgaaagactatcagccccagccattgggtgaaaaacgttcttatgcagttttcttgcccttagtctggtcagacaatcagtggcaggtcttatatgagattcggagcgagtccatttctcaaccgggagaagtttcctttccaggtggcggagtagaggtaggagaaacgccacagcaagcggccgttcgggaggttatggaggaactaaatattcaacctgaacaaattgatatactcggagaaattgattatttggttttggagtgctcaaccgttcattgcttcgttggacggttaaatcttgattggacgactatccttcctaatgaagaggttgctcggatatttacagtgcctctatcaactctattaacaactcagccagtctattatcaactggattcacagattgtcccagattgtgactttccctttgaacgtttgagaggtggggttgactatcctttcagtcatcacaaacgctcggttcccttttatgaaaatctatcagaaaatatctggggaatgaccgcccaatttacccatcggtttacggaaatagtgaaaagtaatctatcgtgaaatgataggttatttttgggaggaaaaaccagcctttgcgatatgtatcaacgaaaaaaatggagacaaagctcaatgtgaaccaatgtatataaaaacacaaaaaaaacagatgcatggcagataaaagatagctatggctggtatacttggtacggtccatattttgaagtaccatcatctatccaggaatgcgacaacattcatgtaaacgcattcagtgcttgttgtcatttccagtaggtgagtgggaaaatgtataaatctatattttaagaaggagccaattatgagcaagcagaaagttgtgtccagtttattattaagcacagtcgtattagggggattagccttttattcaacgacaacggttaaagcagaatcgctagaaccagatgttacatcagttaatgcaagcgatgctactaataaaccggtagtaccaaatgaagagggaggcgactttttagctgaagaggagcttgaagatgatgacactttggaagaagaattaaatgagaaagccgaagaggttactgagccatcttcacctgaagcacttctccaacctcgtgcgatgatgagtgattctgaaactagtggtatggaagaaattccgatgaatgatgaaccttcagataatacggaagaaaaggtagagaagcaacagtcgccattaattcaaacctcaaatgcagattataaaagtggtaaagatcaagagaaacttaggacatcagtatctataaatctgttgaaggcggaagaaggtcagattcagtggaaagtaacttttgatacaagcgaatggtcttttaatgttaaacatgggggtgtttattttattcttccaaatggtttggacttaacaaagattgttgataataatcaacatgatataacagcctccttccctacggatattaatgattacagaaattctggtcaagaaaaatatcgtttctttagtagtaaacaaggtcttgacaacgaaaatggttttaattctcaatggaactggtctgctggtcaagctaatcctagtgaaacagtaaacagttggaaatcaggcaatcgtttgtctaagatttatttcataaatcaaataacagatactaccgaattgacctatactttaactgctaaggtaactgaaccaaatcagcaatcattccctcttctggcagtgatgaagagctttacgtatacaaactctaagagtacagaggttacttcgctaggtgcacgtgagattacccttgagaaagaaaaaactctaccacctaaggagaatccaaaaccagagccagaagctccaaaaccagacgctccacaagcgccatcagcaccggaatctccaacggaagaacctaagaaggaagacgctccgcaaacaccacaagcgccatcgactccggaaaaacaaccagaagtaccggaatcaccaaacccagagacaccagacgcgccatcgactccaaaagatgaaccgcaggctccatcaattccagaagaaaaaccacaagtaccggaagagccaaaacaagaggctccatcagctccgtcaactccggaaaaacaaccagaagcaccggaatctccaacggaagaacctaagaaggaagacgctccagcgccatcgactccggaaaaacaaccagaagtaccggaatcaccaaacccagagacaccagacgcgccatcgactccaaaagatgagccgcaagttccatcaatcccagaggagcaaccaaaagagactccagcgccagaagaacctaagaaggaagatactccgcaaacaccacaagcgccatcaactcctaaagaggaagcaccgaaggaagaagttccaacaccaccggctccatcagtaccagaagagcaaccaaaagaaactccaacaccagaagttccaaaacaagaagatgttcaaccggaagcgccaaaatctgataaagtagaatctgacaaacaaatgccagaaactaagaaaccagatatgaagcaaccgaaggcagacgacatgcctaaggaacaaaagccgaaagccgacgagccaaaggcagagcaaccacaaatggacaaaccacaaatggaagctcctaagaaagattcggaagcgccaaaatctgataaagtagaaactgacaagcaattgccagaaactaagcaaccagatatgaagcaaccgaaggcagacgacatgcctaaggaacaaaaaccgaaagccgacgagccaaaggcagagcaaccacaaatggacaaaccacaaatggaagctcctaagaaagattcggaagcaccaaaatctgataaagtagaaactgacaaaccaatgccagaaactaaacaaccagatatgaagcaaccgaaggcagataaaccagaagcagagaaagctcaaatgccacggacagagggtatgaagcctgaatctaaggcttcaatgatgccaaaagcagaggcaccaaaagcaactttgccaaatacaggcgaagcaagtagcgcaataggctggctaggtggtgctttagccactcttgccacaggcttgtatctattcaaaaacaaaaaagaagaatagtcattattgaataagatataagaacttccctcttctaagttcataaaagactccagatcatcgctgtagaagccttggtttggagtctttttgttaaatattcttagaaaataacaaaatagataaatattagataccctctagaaaaaatttagtttaggatgttatactaacgctaaaacaataatatcaatttttgaaaatactagattggaataaaaatctaatcgccatattttagaacctgtacttacaagtaaagagcttttatgtaagagatagtttttcgctaatcaagttaattttttgagggaatgctggctgtattttgaaaaaacgaacgatgagtagcttaaaaatgccttagatgggagtgctaacctgtaaatacaggttcttagtaaattgaagtaaatagagtaaaggagcacattatgagcaaacaaaaagttgtgacaaatctattgcttagtacagctgtactaggtggttttctaatatgtcacgcaccatctgtaagcgcagaaacaggcaatcttcaagaaatacctactgaatctgctacggttagctcagaaaatcaaactgcgaccgcagtcgatggaatttcacctacggataaccaattacctacgtcagaagagggtgataaacaggctccagaagaaaaactagtttctagcgattctacgagagaagaaagtgctacgcaggtagcgacagatccggatgcaccatctcaatcattaagtgtgtcaggggcggaaatttcaacggcagattcaaatattcaacaagccgaagagaaactgattcaagaatcgaattattatagatttgacacgcatcaaggtgaacagattaggaaggcagtatctatagaaaaaatatcggcagataatgacgaaattaagtggaaagtaacttttgatagaaaaaattggacctttagtggagaggggagtggctattactttattcttccaaaaggcttacaattaaccaaaattattgatagccagtctgaagaggatattttcaataagttccctaaggatgtcaatagtgaggcaaattctggcgggcagccgtatcgcttttttagtagagaaaaaaatgctaataatgatgagcgtagttttgaaagtcagtgaggttggtctgttggacgtgtaggaggagagctagaaaaatggaaggaagaaagttccagcatctattttctacaagtacagcgagattccgttgctaaagaaaaagcgacatatgaactgacggcacaggtgacaaatcgagaaatgcagactttcccggttttagctgtggtgaagaattttaaagagcgaatatttttctccagagatgagattacttctgctgctggtttgagattaaaggtatcggaaagtgctaagccaaataatgaagggattactattatcggagattcatctccagaaagcgacaggactcctgaaccgcggggagataggactccggatatagatgtaccaaaggcagaggttccaaaagttgagcaaccaaaaccaaaggcccctgaagttcaactgcctgctcctaaggctccggaatctgtgccacccaaagtaatgtccccagcccccaaagttccagacgttaagacgccaaaagaggcgcctctgccaccaaaaactccgggcgttgaggttccgaaagtaattccaccgaccccaaaagccccagaagttgaggttccgaaagtaacaccaccgacctcgaaagttccagaagttgagacaccgaaagttgagcagccaaaaccgaaggttccagaagttcaccttcctgctcctaagtctccagaagttgaggttccgaaagtaacaccaccaacctcaaaaattccagacgttaagacgccaaaatctccggaagttgcgcacccagaagttgagaaacccgccggaatccaaccagaaaagggtcaacctgaggttaataaacccaatattatccattcggaggtgcttcaatccgaagttaagaaaacggaatctggagtttcaatggctccaaaggtaggaatacaaaaagagactttaccaaatacgggtgaaacgagcaacaccctagtatggctaggtggtgctctagctacccttgcatcaagtttgtatcttttcaaacaacacaggcaaagagaagaggaatgattttacgctaatgctatatttttggaacgccaataaggcttatctaccatggactaagaaaatttagaacagttgtaaatagaaaacgttccaaaatctgaactgcaccccaaaagttagaggtgaaatctaatttttgaggtgcttttcttgtaaggtcaagacacaaagacaagattgaaatttatcgtttgcaatgatatgaaggagttggttatatattttgttttatcaatactagtttgaatgttattcgagaatttgtaggacattctgaggatggtaaggagatagtgaaaatctatcttcatgtaatacaaaaaggaaaacgtaagattgaacaggctatgctagatttagcagaaattatcatttgatttattttaatcagttaaaattcagttattttgtcaaaaacaaaagaaaaaagcctttgaaacgttgatttcataggctttctgtatgttgtcttattttacctcagtaaaaatcacgtgcttacgcaattttggtgagtattttttcaattgaagacggtctggagtgttacgtttgttttttgaagtaaggtacaaacgctcaccagattctttgtgttcaagtgtaatatttacgcgcatggtatctcccttctattattcagctgaagcagccttggcaattttacgtcctttgtagtatcctttcaaagatacacggtgtgaacgtgagtaatctccagtagtttcatcaaatttcacagttggagctgctactttatagtgagtacgacgtttgtttttcttcgcttttgaagtgcgacgtgcaggtactgccatttctttcttcctccattaaatgtcagggtcaagccctttttaaatctaaaaatagtgcgtatgactttcgccaactttaacagtataacaaaagttttttgtaaagtaaagttacttgacagatttttttcacttttttggaaaatagcagagcatttatggtaaaataaggaggattgcaaggctcgactggtagagtttgagcccttatgacttaatttggaaaggaagaagcacaacttcgagcgatataagttggctctatacactttattatgaaactacaaaaaccaaagggaacacaggatttactaccgcaggattctgccaaatggcagtacgtggaaaactttacccgcagcattttcaaacagtacaattacgctgagattcgcacaccaatctttgagcattacgaggtgatcagccgttcggttggcgatacgacggacattgtgaccaaggagatgtacgatttctatgacaagggagagcgtcatatcaccctccgtccagaagggacggcaccggttgttcgctcctatgtagagaacaagctgtttgctccagaagtacaaaaacctgctaagttctattacatgggcccaatgttccgctatgagcgtccgcaggcaggtcgtctccgtcagttccaccagattggtgtggagtgctttggttccaataacccagcgacagacgtagaaaccattgctatggcctatcacttctttgaagagttggggatcaaggacattcgcctccacctcaacagtctgggcaatccagagagccgtgctgcctaccgtcaggctttgattgactatctgacgccgctcaaggaacagttgtctaaagatagccagcgccgtctagaagaaaatcctttgcgtgtgttggattccaaggaaaaagaagacaaggttgctgtggaaaatgcaccgtccatcttggactatctagatgaagaaagtacagtccacttcgaggcagtcaggtccatgctggacaacctaggcattacttacacaattgacaccaacatggtacgcggtttggactactataaccatactattttcgagtttatgacagaagtgggtggcaatgacctgaccatctgtgccggtggacgttacgacggtttggtgacctactttggtggaccagaaacgccagcttttggctttggtatgggcattgagcgcctcatcctagtccttgaaaagcaaggcatcgagctccctctcgatacccagttagatgtttacatcgcggttttgggtcaggaggccaatggcggagcgcttgatcttgttcaagccattcgcaagcaaggtttccgtgcagaacgtgactatctggaccgcaagctcaaggcccagtttaagtcagcagatgtctttggagccaaggctatcattaccctgggtggtagcgaaattgaatctggacaggttgtggtcaaaaataaccagacaagaagtcaagttgaaacaagcttggaagcacttaaaacagattttgcaagtattttagaagaattggagaagcagtagtctaaagctgcttctttttattttagaaagcaaaaaagaagcgattggataatcacttcttgaaaatagtggagaacgcattagtgtgagtggcagaagtctaagaccatacgaccttggatagtaccggcaaccatttcattgaagactgcttcggcatcttcgacagggcgtttttgaacgactggaacaactagtcccatagcaccgaagtggaaggcctcttctaaatctttacgagtaccaactagtgagccgaccactttgataccgtctagcacagtcttcacgatactgaggtccatgtattcagatggaagtccgacagctactacatatccaccagcacgaacactgtcaatagcttggttgaaggctactttggaaacagctgttacaacagtagagtgtacaccgccaccagtaatttctttaatatatccaggaacatcttctacttcaagtccgttgatcgtcacatctgcaccaacttctttggcgagttccaatttatcattattgatgtctacggcgataacatgagcgttgaagacttttttagcgtattgtacagcaaggtttccaagtccaccagcaccatagatagcaatccattgacctggttccaagtgagcttctttaatcgctttgtagcaagtaacgccagcacaagtgatagaacttgcttgagctggatcaagaccttctggaacttttactgcatagtccgctgttacaatacattgctcagccataccaccgtcaacagagtagcctgcattttttacggtacggcagagagtttcgcgaccggttgtacaatattcacacataccacagccttggaagaaccaagcaacgctgacacggtcaccaacttttagactggtaacaccaggtgcgatttctgtaacaataccgattccttcgtgaccaagaacgcgaccaggaaccttaccaaaatcaccattggcaacgtggaggtcagtgtgacaaacaccacagtactcaatttggaccaaagcctcaccagcttcgagtggacgaagttccttttcgacaacgacaacaccagtagattctggatttacaacgactgctttcataagcagacctcctgttttaatattttatgtacatttttggatgtgttaatatagttgttttatattgttaagaatatcacaatgtgaacaaaaatgcaagagtagaaaaggagggacaaatgaatataaaattgaaaattatcacgtaattactacaaaattttcaaaaaaatctatttacatggaagcgttttcttgataaactagtatcgtaaatgttagagaaagaataaatgataaagatttgtcttactttatgtatttttcgaccaaacaaagcagaaacaaatctgaacgttttctgaaaacaggaaaaagtaagcgctttccaaaacaaaacagaaaaaatgtgaaaaaattaacaatttctctttacaaataaaataaaaaatagtagaataacattgtgaaaaagttaacaaatagttagcaagtatatttggaggaacacaatggctgataaaaaagtagtatcaccagaagaaaagttggtagaagcgcgcaagcacgtcgatgagcttgttcaaaaaggtttggttgctcttgatgagttccgtaaacttggtcaagaagaagtagactatattgtagcgaaagcttcggttgcggcccttgataaacatggcgaattggcaatgcacgcctttgaagaaaccaaacgtggtgtattcgaagacaaggctactaagaacttgtttgcctgtgagcacgttgtcaataacatgcgccatacaaaaacagttggtgtcatcgaggaagatgatgtaacaggtttgactttgattgctgagccggtcggtgttgtttgtggtatcacaccaacaacaaacccaacttctacagcaatctttaaatcattgattgccttgaagacacgtaatccaattgtctttgccttccacccatctgcgcaagaatcttctgctcatgcagctcgtgttgtctatgaagcagctgtggcagctggtgcccctgaaaactgtatccagtgggtaacaaaaccatctatggaagcaacgtctgagttgatgaaacatgatggtattgcaacaatccttgcaactggtggtaacgcaatggtgcgtgcagcttactcttgtggtaaacctgcccttggtgtaggtgcaggtaacgttccagcctatgttgaaaaatcagcaaacatccgtcaggcagcacatgacatcgttatgtctaagtcatttgacaacggtatggtctgtgcgtcagaacaagcggttatcattgataaagaagtttacgatgagtttgtagcagaattcaaatcttacaaaacttacttcgttaataagaaagaaaaagctcttcttgaagaatactgcttcggtgtgaaagctaacagcaaaaactgtgctgaaggtaaattgaacgcagacatcgttggtcgcccagctgcatggatcgctgagcaggccggcttctcagtaccagaaggtacaaacatcttggcagctgaggttgctgaaatcggtgagaaagaaccattgactcgtgagaaattgtcacctgttattgccgtcttgaaagttgaaggtcgtgcagaaggtcttgaagcagctcgccaaatggttgaattccacggtctcggtcactctgcagctattcatacggaagacgcagaattggcgaaagagtttggtacaatcgtacgtgctatccgtgttatttggaactctccatctactttcggtggtatcggtgatgtttacaacgcattcttgccatcattgacacttggttgtggttcttacggacgcaactcaatcagtgataacgtaagtgctatgaacttgctcaacatcaagaaagtaggaagacgtagaaataatatgcaatggtttaaagttccttctaaaacatacttcgaacgtgactctatccaatatctccaaaaatgccgtgacgttgaacgtgtcatgatcgttacagaccgtgccatggtagaacttggattcctagatcgtatcatcgaacaattggaccttcgtcgtaataaagttgtttatcaaatcttctcagacgttgagccagatccagacatcacaacggtttataaaggtacagaattgatgcgtaccttcaaaccagatacaatcatcgcactcggtggtggttcaccaatggatgctgccaaagttatgtggctcttctacgaacaaccaacagttgatttccatgacctagttcaaaaattcatggatatccgtaaacgtgccttcaagttcccagaacttggtaagaaatctaagtttatcgcgattccaactacctcaggtacaggttcagaagtaacaccgttcgccgtaatctctgataaagcaaacaaccgtaaatacccaatcgctgactactcattgacaccaactgtggcaatcgttgacccagcactcgtattgacagtacctgcacacgttacagcagatactggtatggacgtattgactcacgctacagaagcatacgtttcaacagtagctaacgactttacagatggtttagcacttcaagctatcaaactagtatttgaaaaccttgaaagctcagtgaagaatgctgactttgtatcacgtgagaaaatgcacaacgcatcaactatggcaggtatggccttcgccaacgcattcctaggtatttctcactcaatggctcataagattggtggacgtttccataccgttcacggtcgtacaaacgctatcttgcttccatacgttatccgctacaacggtactcgtcctgccaagacagctacatggcctaagtacaactactataaagcagatgaaaaataccaagacatcgcacgtcttctaggcttgccatgctcaacaccagaagaagctgttgcagcatacgcacaagcagtttacgacctcggtgaacgcatcggtatccaaatgaatttgaaagcacaaggtatcgacgagaaagaactcaaagaacactctcgcgaattggctcttcttgcctacgaagatcaatgtaccccagctaacccacgtctagcaatggttgaccacatgcaagaaatcatcgaggatgcctactacggttacaaagaacgtccaggtcgcatcaagtaaggattttcgtcacgatacatcgttaaagctccttgcctaactttagttatgcctacgtcgctttgccttgtctcgtttagaaaatcattccttagtgatttagattcgccttcgtcaatctgcctagaaaggcttaggactagaaaaagtctaggtaggagtagtaaatcgtatcctactcagttgaacggagtaggatttataggtaaattgcctccaaatatcgtaagacaatcctctattgaaaaataggggattgtttgtttagaaataatggtggagattctgtaaaaagcgaaagtggttggaaagttagggtttagccgagaaaaagagacttttctatctatctttcacaattttctgtcaatttgtggtagaatagaaaaaatagattttttatgagggataccatgacattagtatatcaatcaacacgcgatgctaaaaatactgtatcggctagtcaagcgattttgcagggcttggcgaccgacggtggtttgtttacaccgctttctattccaacagttgacttggatttttctgttttgaaagatgcttcttatcaagacgttgccaagctgattttgtcggctttcttggatgattttacggcagatgagttggactactgtatcaataacgcctacgacagtaagtttgacacgtcagttattgccccagtggttaagctaaaaggtcagtacaacttggagctcttccgtggctcaaccattgccttcaaggatatggctctgtccatcctcccttacttgatggcgacggcgactaaaaagcacggtttggaaaacgaaattgtcatcctgaccgcgacttcaggcgatacaggcaaggcagccatggctggttttgcggacgttcctggcacacaaatcattgtcttctatccgcgtgacggggtatctaaggtccaagaattgcagatgaccacgcagacaggggctaatacccacgtggtggctattgacggtaacttcgacgatgcccagaccaatgtcaaacacatgttcaacgatgaggcactccgtgccaagttggcggctaagaaactccagttttcatctgccaactctatgaacatcggccgcttggtgccacagattgtttactatgtctatgcctacgctcagctggttaagactggtgagattgcggcgggcgacaaggtcaacttcaccgttccaacaggaaactttggaaacatcttggcagcttattacgccaaacaaatcggtctgccagttggcaagctcatctgtgcgtccaacgacaacaatgtcctaaccgacttcttcgcgacaggcgtttacgataagaaccgtaccttccgcgtgaccaccagtccgtccatggacatcttggtgtcttctaacttggagcgcttgattttccatctctttggcaatgacgctgcaaaaacagctgagctgatggaagccttgaacacagctggtcagtatgacattcaaggggctgacgcggaaatcctctctctctttgctgccgcctttgcgacggaagaagaaaccgctgcggaaatcaagcgtgtctatgacgagtcagactacattgaagatccacatacggctgttgcctcagctgtctataaacagtatgtggagcaaacaggggaccaaactccgacagtgattgcttctacagcaagtccttacaagttccctgtggttgcggtagaggcggtgacaggccagtcaggtttgtctgactttgaagcccttgcaaaattgcatgagatttcaggtgtagacttgccaccagctgtggacggcttggaaacggcacccgtccgccacaataccgtcgttgcagctgccgatatgcagactgaagtagaacgctatttgggtgtttaatttcgatttattttatgacaaactgctcattttgaacagtttgttttctttttgtggtttaaattaaaatttacagataattcaaagaatgatatactatataggaatactgaatagtgaggtggatgatggcacaagagcaggagaaaatctccagagaaaagaaaaaagccctcttgaagcggctcaaagaacgcatcaaacccaagatgaagctggtttatttggcagcctttctatcatgggtgcaatttttgatgcggattatttccttttatctgattgctaagggctttgtgagctactatgagggtggggtggtcaggttgatctggtacgctttgtcctcatcttgctggggctcaatgcttttggctatggtgtggctctgattgccaagcgtttgcaggggctgggctcccagtttgcacgggattcgctcaagcagtctttctttgaggttcttttggccaaggatggtcagtttgcgtccaaagcgacggcggcggatgtttttaacatcgcttctcaggggattgatagcctggatacctactattcctactacatggcttcgtccttgcggacccagttcaactgtgcgacggttctcttgctggtttttctgattttcccgctgggtgcagtcattttcatcttggccttgcctctgattcccatttccattatcgctatgcagaagcggtccaagcggatcatgaatcgctattggggttcctatatggatgtgggcaatcttttcctggatgacctcaagggcctcaacaccctctattcttatcaggcggatgccacctacgaaaagaccttcaatgaacaggccgaggacttccgcgatgcgaccatggagttgctcagctttcagttgcaagcggtgggctacatggatgcggtcatgtatctggggattggcttgtctggttttgtggcggtcaatagcctagcagcaggcaatttgtccctctttagtatgctcttctttgtcctcattgcgacggagttttttgcacccatacgggaacagggctacggtatgcacttggtgatgatgaataccaagatggcggatcgcatttttggtttcttggacagtatgacagcggagcaggaaatcgattctgtccatgtgcctgcttttgacagtctaaaactagaagatttggcctttgcctacggagaaaagccggtcctagaagatatttccatgaccatgccggctggtaaggtatatgctttggccggcgagtcagggcaggggaaaacgaccttggcccagctgctcttgggacgcttgcgggcggataagggagctatttacttgggtgagcaggagatttcaggtatcagtaagctttctctgaatgagcaggtcctctatgtgtcgggccagtcaaccttgcttaaccagtctatctaccataacttgcggatggcttgtgactggtccaaggaggacatcttggcttgggcagatcagcatggggtcttgcagtttgtcaagaatctgccagacggtttggatacgattgtgggtgatgacggtgctttcttgtcgcctggtcaacgccagcaggttatctgtgcccgtgcggtcttggctaaacgctccctttatatctttgacgaggtgacgtccagcgtcgatcaggacaatgaaggcttgatttacgacctcattgacttggtggccaaggatgcgattgtcatcatcataacccataagatgaaacaggtggagcaggcagatgacatcctcttcctgtctgcggagggagctgtgacaggcaactatgccacgctttatcagactagcttggcttacggtcaactggtcgatcaacaaagagaattggaggaagcagtttatggataagaaagaaatgccaacacgagtgctgattccgagactcttgcagtccatgaagcacctcttgccacggattgcggttgcggtttgctttgcggtcttgggacaggtggtgaccattgctattccagttatgctggtctatctggctttcaatgcccttactggcaatcctgctccgctatggaccttgggaatcctcattctcctagctcttttacgtggtgccttccgctatggtgagcattactttggtcattatgtggcctttcatacgctggcggcttaccgtcgcttgattttcgcaaaattgcgggccttggctcctgggaaattggaccggcaggacagcggtagcctgcttaagatgattggggaggatattgaggccttggaggttttctttgcccataccattgccccgatttgtacagggattttggtggctcttggtttgacggtctattttggtctatctagttggggtttggcttttctggctctggtgacctatgctcttttagcgattgctattccaaatcagtttgctcagcagttacaacccttgctcaaggagcaaaatgctagccgtaagggctatgtgtcctactttattgaaagtcttaagagcatgaaggatctcatgcagttccagcagacagatgctcgcttcgccaatctgactcagaaaagccaagaggtcaatggtcaggagagaagggtcgcccagaccaacttcatgcagtatgccgtctccttcttggtggtcggcttgtctatcatgggctttgcctggctgaccttcgacttggtgggtagtcagagtttggacttagcaacaggagtagccctgctggtttctttcattagctcctttgctcccttcttggaactcagccgtctgcctcttggtttcaagcgggctatgaatgctggtcgcaacatctatgctcttttggatgaaaaagaagcagagcgaacaggtgagcttgttgaggtcagcgtgacagacattgctattgagcaactggacttcgactatgatgtccgagaaacaggcctttatcgtaacctgtctgtccagtttgaacagggaggcatcattggtctggttggtgagtctggtgcaggaaaatccaccttgatgaaactaattatgcggtggtatgattggcagcaaggccaaatccgcctgtctggcttggatagtcggcaggtagataaggctcatttgcagggggcttttgcctatgtaccacaggtgccacaaatcttccgccagaccattcgggaaaatcttgtcttgggtcgtacggatatatcggatgaaaccatcatggacttggcagaaaaatgccatatgaaagaacggattttggcagcaccgcagggcttggataggcttgtggaggccagtgatttttcagcaggagaggggcaacgcttggaactcatgcgggccctgctcaaaaatgcggattgctatatctttgatgagccaactagtaacctagattcgctcaatgaagcccgctttatccaactggttaaggaacactgccagggcatggtcttcttgatttctcatagaagctcgaccatggcttgtgcggataccattttccgcttggaagacggacaattagtaaaggaaaaataaatgaagaaattacaagtaaaagatctgatggtaacaggggcttttgctgccctctactttgtttgtgttggtctaggaaccttgttgagcttggtttttgatcgttcgggtaatatgatgtatgcacctgcgggagcagcccttttggcaggacctgtttatatgttattggtagccaaggttggtaaatttggttcaattagtctggttggagcagtaatggcctgtttctttttcctatcaggctatatgacagcggcctttctcccaagtttgacctttggttttttggcagaaatggtagcgaagtcaggtcactataaacaaaaatggaccaatctttttagctatatcattttctcttttggaaacttaggacctattattcttatgtggttcatgcgagatgcctatgaggccaatcttttggcacgtggaaaatcagcagaatacatcgctcgtgtcatgcttgatttcactccagagaatgtgctatggttgtcaacgaccattatcttaacagctcttatcagtggtttgtttggtcaatatatgcttcagcgctattttaaacaatcaggttatctttcatgaaattagatgctcgtacaaaaattattctcgtcatcttcactagttttacctatgggatgaggcttacaatattagaaaatgcagtgctggtcttaggccttagcctgcttttctggttttctggaaagcggaaaatggctataatgagtccgatagcctattctattttttgtctgttgtcctatattacatttttaccagcatggctgacgcatttgttacttgtattgacctatacatggcctccgcttttggcaggacatctattactgatgacgacaagtggttacgaactcattcatggcttgcggaaatggcacctgccagaggtatttcttttgacgttgggagtaatgtttcgtttcctacctgccattaaacaggatgctcgtacgatttgtgcctctttgaaggttagaggaatttttttacggaagagagatgtggtttgtaagccactccagtacatggagtttttcttggttcccttgatgatgtctctcttgcgaacagctcaggaattgacagtagccagtctgacaaaaggtttggctgtgtctacgaaatcacctgcatatatttggtcgtcttggaccgtgctagattggagtctttgtttatgttgtctcggttttctgattctcgtccggctgtgacggtaaaaaatgtagcattaacttattcaggagcagataaaccagccttgcagatagaggatctgaccattccagaaggacagtgtgttgttttatgtgggcagagtggttctgggaagtctagttttctcaaggtattaaatggtttgacgccagaatattatcctgctcagctttcgggacaaattttcttaggggacttggatttacaaaaatctagtctggaagaaatatctcggcacattgcttcagtctttcagcatccgtctactcaattttttcatagtcaggtcttgcaggaattggttttcccttgtgaaaatcagggtttgtcaagagaagaaatcgagaatcgcctggcttgggttatggaattatttggtttggcttctcttagccagcgaacgatttccagtctatcaggtggtcagcaacaacgtctagccttggccgttgcaactatgcaagggacagatgtcttggttttagatgagccgactgccaacctagatcaggaagggattgtgattgtagaggacatcttgaaaactttaaaaagccaaggcaagaccattattattgccgagcatagactgtcttatctcagtcaattggcagatcgctatttatattttcaagatgggcaagtggtgacggattatctagcagatgagtttttaagtcggacagaagaatgccgtcaggatatgggactgcgttgttatgactcggagccttatgggcgggcaatagcggagctggcagaccagtttgttaatgataaagaggggttacttgttgaaaatttatcggtaagtcagaaagagaatactctctacgagattgaaaaactctgcttggcaccaggacaggtggtgggtttggttggagcgaatggttctggaaaaacaagccttgctcgttatctggtcggtttagcggaagataagaagagtaggatttcttggcaaggtcaaaccttatctagtcgccagagattggaaaaaacagcctttgttatgcaggatgttcgactccaactatttgcggaaagtgttgagcgagaacttactcttggaaggaaaaatagagctgtcgatgaacatttggtggctcgttttggtctatcggatttgttggagagacatccggtcagtttatcgggtggtgaacaacagcgcgtgatgatagtagctagcttactggcagataaggaaattttcatttttgatgaaccgacgagcggcttggatttgagacgaatgcaacaagttgcttccgctttagtagacttaaaaatgaagaataagttggttttgttaatttctcacgatgaagagctattgaatctggtttgtgataaaatagtagatattaaacagttgaaatagtgattatgaacaaacaaacctataaagaaattttaaccattgcctttccagccatgggggaaaaccttctccagatgttaatgggggtagtagactcttatctagtagccagtattggcattgtagctttgtctggagtttcccttgctaataatattttagccgtctatcaggcggtttttattgccctagcagtagcggtgtcttctcgtttggctcaggctttgggtgaagggggttcagaaggcattggaggaactgctagtgaaagtgtcaagtttacagtttttatcggtctccttttaggaattttttcagttctggcaggtccaatagtacttactagcttgggggcagagtcagaagtggtacaggctgggggtctttatttgatattggttggtgggggagcaccttttttgggactcatgacaagtttgagtgcaatcttacgaaccttgggggaaccacgttttcctatgtatatcagtctgctctcaaacgttctaaatgcactattttcagcatttgcagtctttgtgcttcatgcaggtgtagctggagttgcgattggcacggtattatcgcggttgattggttgtagcctgctttggtctcgcttaccaatttctttaaaaccatggacctggtcctttgataaagaactgcttagacttgccctgccagcaactggtgaacggttgatgatgcgggtgggagatgtggtagtcgtggcgttgattaccagcttaggaacagcgacggtagctggaaatgcgattggagaaaccctgacgcagtttaactatatgccggctttagggattgctaccgcaacaatcatccttacagcgaaacacagacaggataaggctatggttcgacatatttttcgaacaagctttggcatttctttgctgtttatgtttttggtggctggtgtgacttattttgcggggtctttcctaatcgacctttatactaaggatattcaagcagcacaagctagtcaaacagtattattttatgccatgttgggagttccctttacagctggcactcttattatgacagctctttggcaaggtttgggaaatgctagattacccttttatgccacaactatcggtatgtggctagtgcggattggcatagcttatttacttgtaacattttttaaaatcggtttgtcagccatttggattgcaacgattttagataatgccttccgatcaggggtgctattttttcagtataggtattcaaaacaagaatcaatttaagataaggctaagaaaattttcagtttcttttaagtttgtagctatatactatattcaagctagaaatagcgaatttctttttcatataatctccagagaacagtcgaccgcggtcggctgttttcgtgtcaagttttaagaaaataagtatgagaaattgctttagaaaaatctaagaaatctttcagtttcttttaagttagtagctatatactatattcaagctagaaatagcgaacaactttctttttcatataatctcctagagaacagtcggccgcggtcggctgttttcgtgtgttctattcttatgtaaaaatggtataatagtagtgattgtgtaaggagaaaagtatgtcggtagtaggaaaagcaaatggaaaaatcattttgatgggagagcatgcggtggtctatgggcacccagcaattgctatgcctttttctgctgttgaaattattgctcaggtaactgctcaaggggaagcgctgactgttgcttgtgacttctataaaggcttagttcacaagatgccaaaaatctgggaaagcctcaagcatgccatccgtttctcgctctatcgtatcggagcgccgacagacccagctattcatatcgagattagttccaccattcctgccgagcgtggcatgggctccagtgcagccgtggcagttgcagtagcacgcgccctctttgcctattatgaaaaagagctgaccgacagcgaactctgggacatcgtccagtcttcggaaaaaattgctcacggcaatccctcgggtattgatgcggcgaccaccagcggcaagtcccccgtcttctttatcaagcaccagcccatcgaaccttttgagctgaaactccatgcccatttggtagtggctgacacaggtgtgacgggaaataccttagaagccatttcagacgtggcagatttgttggagaaaaagccagaggctatcaagctagtagaagaactggggaacttgacccgacaggccaaggaagatttagccacagaccaggcagagcttctaggcagcagaatgaaccaagctcatgccctcctgcaaaaattaggcgtgtctgatcctagcctagataagctagtcagccttgcccaagaaaatggagccctcggagccaaattaactggtggcggacgaggcggttgcatgattgccctggcaagaacagctcaggatgcccaaaaacttgcacacatccttgaccaagcaggcgcccgccaaacctggatacagtacttaggagaaaccaatgactaaacaaataggcatagcccgtgcccataccaatattgccttgattaaatactggggaaaacgcgataaggaattattcctacctatgaattccagtttatccctgacccttgacgcattttatacggataccaaggtcgtttttgacccagaattaactgctgatgagttctatctcaatgggattttacaaaaagaaaaagaaattttaaaaatttctcgatttttggatttattttgcgaatatataggtgaaagggcatttgcccgagtggaaagtctaaattttgttccgactgcagctggtttggcaagctcagcatcagccttcgcagcgcttgcgcttgcaaccgcaactgccttggatttagatttgtcaccagccaccctatcaacccttgctcgcaggggttctggctctagtacccgtagcctattcggtggatttgttgagtggggcatgggaactggttcggaagattcgatggctcatcccattgatgatgcggattgggatatcggcatggtcgtcttggcggtcaataccggaccgaaaaagattgctagtcgagagggaatggaccacacagttgccacctcaccattttacacagcctgggtagaaactgctaagcaagacttggtggacatcaaggcagctattgccagccgtgattttgaaaaacttggtcagattacagagcacaatggcatgaaaatgcatgcaacaacgctctctgccaatccaccctttacctattggtcagccgatagcctagtggctcaagaggcagtccgtcaggttcgtgaagcaactggcttatcagcctacatgaccatggatgcaggaccaaatgtcaaggtcctctgtcgagcaagtcagatggatgagctagtagctggattggccaaagtcttcccaagagagaaaatcatcaccagcaagcctggacctgctgcttatgttctcagtgagaaggattggcaggcatcacaaacagcatttgaaaagggaatctagcatgaaagtgcaagtaaagataccaggaaaactctttctggcaggggaatatgcagttgttgaagctggctatcctgcggtgattgcggcggttggccagtacctaaccgtcaccattgaaacaagtgaccaaggcagtcttcattctagtcaaaaggcagacctttatctgacctgggagcgtaaggaaggtgccgttcgtattcaaggtagccatccctatgccttgattgaatcagctatgcaggtgacagaagcctatctgacggccaagggctatgcttgtcatggaacctatagcctatctgtacagtccgacctagatgaccaagcctctggtgccaagtacggtctggggtcttcaggagcagtaacggttgcgacggtcaaggccctgttgacctattacggtcatcaagcggatgcccttttgacctacaagctagcagctctgacccagtccaagctaggcatgacaggttcctttggagatttggcggcttccagttttggcggcttgatagcctatcattccctggaccgttcttggcttttagggaaaatggcagagctgtctctgctggatgtggtggaaagtgattggcaaagtttgtctatcagccctatccagttaccccaaggtctagacctcttggttggttggacagggtcggcggcttcaacggatagtctagtttcccagatggaaagccaaaaaagtcagacagaaaaagagcaaattcatagccagtttttagccgactccaagacttgtgtagagcagttgatagtggcctgtcagacaaatgattcagtatcagctagacaggccttgtcagctaatcgcaagctcttacaggactttgcgagaggaatgggcttggtcattgaaacgcctcaactgagtcaactctgtgatctggcccaaacttatggagcggtggccaaatcatctggtgctggcggaggtgactgcggtatttgcttggtagacagtaaggaacaaaaagcagcgatagagacggcttggcaagaagccggtatttttccactcaccctaaacatcgcaagtagagaataaggagaaccctatgttttatctaggagaatttggtttagatcgcaaggatcaacacgttggcttggccaatcagcaatatagtgccacgccggccaaggactttacagaaactctgtttgtccatcattccctgccgcagaccaaggtggatgaagtggatatttcgaccagtgtagctggtttggactttgcctttcctttcttcatcaatgccatgactggtggaagcaagaagacccgggaaatcaaccgtctgttgggaattatggggcattttggcaagattgccctggcttctggttcggtcagtgcggcaatcaaggatccgtctgttgcggaaaccttctctgttatgcgtcgggaaaatccttacgggataatctttgccaacctaggtgcccatcatagtgtggaaaatgccaagcgggcggtggatttgttggaggccaatgccattcagatccatgtcaatgctcctcaggagattgtcatgccggagggggaccgtgatttcactatgtggttgaagaatattgaaactctggtgcgggagatggaagtgcctgtcattgtcaaggaagttggttttggcatgagccgtgaaacagtagcccagctggcttctgccggcgtgcaaacaattgatgtatctggtactgggggaacggatttcgccaagattgaaaatgcccgtcggaccttcaatgactatgcctatttagaaggttggggccagtctaccgtgacttccttggtggaagctatgtctgtttctgaagaagtttgcccaagcctgattgcttctggtggcattaaaacaccgctagatattgtcaaatcattggctttaggtgcagaccttgtcggtatgtccaatcatttccttcaatatgtcaaggatggaaaagggcatcgttttgacgacggtttgcaggctattaaggtctatcaatggcagattgctgaaatcatgaccatgctgggtgctaagaatattgcggaactccggcagaaagatctggtcttggcaccaaatgtccagaactggtgtgaggcgcgtgggattgattggaaagcctatgcccgtcggtcagcgaatgtgagttaaagagagatagattgatgtcttcagttctcaacaatgtagaaaaataaaaaagccaggtccattttggaacttggcttttgtcatggagtggtttctaggttgctgttaactggcctgcttgtaactggtacatacggtggtagtgacccttgagggctagaagttcttcatgattgcctgactcgatgatctttcccttatccaagacataaatacagtcggcatcctgaatggtcgataggcggtgggcgatggcaatggttgtccgcccttttcgcattttctcaagagaagtctggactgtcttctccgtctcagaatcgatattggcggtagcctcgtctaaaatgagaatcttaggctggctagccatggtgcgtgcaaaggccagcagttgccgttgtcctgtcgaaaaggcggagccccgctcggtgaccaagtggtcgtatttctcaggaagtttttcgatgaagggagcagcgtccacaaatcgagccgcttcctcaatctcctcctgagaaatatcctgatacatctggatattggatgcaatggttccgtgaaatagaaagggatcttgcaggactaggccaatcgcggaccgcaattcttcctgcgaaaagctacgaatatcctgaccgtcaatcaaaatccgtccagattggaattcatagaaacgcataaagacattgatgatagaagatttgcctgatcctgtagcacccacaaaggcgatggtctgcccctgtctcacttcaaaggaaaccttgtccagaatttgccgcttgccgtcataggaaaagtaaacatcctcaaagacaatatgccccttgtcaatcttggcccctcggtccagctgtagtggctcctcgatggtctggtccatgagcgtaaagacccgtccggcagataccatagaggtttggagggtggaaaaatgctgcgtgacatccagcaagggatcgaaaagacgattgacatactggatgaaagcatagataagaccagcagaaattccagcctgtgaccagtccaaaccaaaataggtcatgagtagggcataggccaaaatcttaacaagtgacagggcagggcggagaaagagactgtccaaggccatggaacgactggcatagtccagatgttcctggttgatagcctcaaactcttcctttagcctctcctcttgagaaaaggcctggataatccaaatcccctcgatgctctctgccagtttgctgttgatggcactcaacagacttctagtcttggccacaatgggagctgaccgcttccgatactgatcaaccaggatgaaaatcacgggcaggaagaggacaatcagactggtcaatttccaatccagagcaaacatggtcgaaagagtcgtgacgataataaagagagctgagataaaactggataaaatccctgaaaacatctctgaaatactctccgtatcattggtgatgcgagagacaatggaaccactaggagtctggtcgaagtaagccattcccagcttttccattctcccaaaggcatcccggcgaatatctctgacaatgctgtaggaaactttagcaaaccagagatttccaaaatattgaagtaccatttgaagcagatagagggcgaagtaggcagctagaatggccacagcagtctcagaaatagtagaaatgtagtggtcgataaaataagaggctagaaggggaattagactgcggaccacggtagtcagtagcaaaaagctcaaggcaaggactgtcagcagtcgataggctttgagataggacaagagtcgcaaaaaaacactagcttgcttggttttagagagcatcactttcctccttttcgagttgctgcatcatataggtatcgtagtaccagcctttttcatctagtaattcttggtgacgacctcgttctacgatttttccatcttcaaggaccagaatcaaatcggcatggacaatagctgacaggcgatgggcggtgataatggtggttttgtcaaggcgttcttgcttgatggtttcgagaatagcgtgttctgttttagcatccaccgctgagagcgagtcatccaagagcaggatatctggattgagaatcatggcacgggccatagccaaccgttgtttttgtccgccagaaagggaaatccccttttcgccgaccatggtttcaaagcggtcgggcatatcctgaatatcctcatagacatggacagcccgagcggcctcttctacctgatttagagataaatcgggattgccgaagcggatgttttcagtaatgctggtcgcaaagaggaactggtcctggggtacatagccaattaagcgtcgcaggtcagctagcttgtagttcttgatattttcttgattgagcaagatctgtccatttatcacatcgtattctcgcatcaggagcttgagcaggcttgttttcccagaacctgttagccccacaagaccaattgtctgcccttttttgatctgaaactggatgtcttggaggactggtatgttatcataggcaaattcgctaatctcatagacaagctctccattgcttggtgcaggcagcggttggtctgtttcaatgacctctgaggaaatgctgagaagggtctgaatccgattgtaagatacatcaccacgctggctaatattgaccaaaaaaccaatcgccataagaggccagacgaggagatctaaataggtcatgaaagttactagttggcccagactgacctgaccttgcgagatgaagtgagagccgaccagaagggtcagcaggtaggacaggccaatgaagaagaggacggcagggttgaacagggcatcgtaacgcatggttttgatattctgcaagaaggctgcttggttgacttcctgaaaagccgccgtttcttgttcttggtagccaaaggatttagtaacctttataccagaaacagcttcctggaccttgttgttaagctctgaaaaggctgcctgtgaagccttgaaattttcatgagtgcgacggcctaaaaaattagtggttagagtcatgaagggtagggggaggattgcaaccaaggtcatctgccaggaaatgctcaaactcatcgtaattagggtaaccaaggctgtgaccgttgcatcaacaaaagacatgacgccaccacctgctagtcgggtcagggcattgatatcattggttgcgtgggccattaaatccccagtccgatgttgctgaaaaaaggatggagataggtgcataaagtggtcaaacagccgagccctcatgatttttcctagacgataagatgttgccaggatgttcattcgccaaagatagcggaggccgtacatggccaaggctgacaagatgagcccagctaccccgagtagcaagcgatgctcagtcaactgtccgctggcaatctggtcaatcaactgccccatgatagaagcgggaaggagattgaggaggctgaccaaacagagtgataaaatcccaatcagataggcctttttctcaagggaaaagaaccaccacaattgcttgataatcttcataaatgtcctttctgaacaaaagaaaggttggtagcttgtcgcaaccaacaaataatagaattcggtgacactagtgtatcacagactggtagaaatagaaagtttgtaacttaaaaattaggcaactctagccgtagccgaatagaagaaacagttggagttgtaaacacgtacgatacaggtagaaatcaaaagatttttacctttttctgtctatttatgataaaatatatgaaaatttagaagaggtgttcagatgaaagctattgttacagttgtcggtaaggacaagtcaggaattgttgcgggtgttgcgaccaagattgcggagttagggctcaatatcgatgatatttcacaaactgttttggatgagtattttaccatgatggcggtggtgtcgtcagatgagaagaaagatttcaccaagcttcgtgcagaactagaagcctatggtcaggctttgaatgtgaaaatcaacattcaaagtgcagccatttttgatgctatgcacaacttgtaaggagagatttcatggatattagacaggttagagaaaccattgaaatgattgaggagcagaatttcgatattcggaccatcaccatggggatttccctcttggactgtatcgactcggatatcgacaaggctgcggagaaagtgtataccaagattgtcaccaaggccaagaacttggtagcagtcggcgatgagattgcggcagaactaggcattcccattgtcaacaaacgggtgtcagtaacgcctattgctttgattggtgcggcgacggatgccacggattaccttcccctagctcatgccttggacaaggcggctcatgagatcggcatcgattttatcggtggtttttcagctcttgctcaaaagggctaccaaaaaggtgatgaaatcctcatcaactctattccgcaggcattggcccaaacctctaaggtctgctcgtcagtcaatatcggctcgaccaagacgggtatcaatatgacggctgtgcgggacatggggcggatcattaaggagacggcggaggcttctgatatgggggctgccaagttggtggtctttgccaatgcggttgaggacaatcctttcatggcgggggccttccacggtgtcggcgaggcggatgtggtcatcaatgtcggcgtgtctgggcctggtgtggtcaagcgtgcccttgaaaaagtgcgtggtgagagctttgatgtggtggcggagaccgtcaagaagacggctttcaagattacccgtatcggtcagttggtcggcaatatggccagtgaacgcctgggggttaagttcggtatcgtggacctgtcgcttgctccaacaccagctgttggcgactcagtagcacgggttttggaggaaatgggcttagaaaccgttggtacgcacggaacgactgctgccctggctttgctcaatgacgcagtcaaaaagggtggggtcatggcctgcaaccaagtcggtggcttgtcaggtgcctttatccctgtgtctgaggatgagggcatgattgcggcggtgcaaaatggctcgctcaaccttgaaaaattggaagccatgacggctatctgttctgtaggtttggacatgattgccattccagaaacaacgcctgctgaaaccattgcggctatgattgcggatgaagcggctattggggttatcaatcagaaaacaactgcggttcgtattattccgcttggaaaagaaggagacatgattgaatttggcggccttctgggaacagctcctgttatgaaggtcaatcaagcttcgtctgtggactttatcaaccgtggtggtcagattccagcaccgattcatagctttaagaactaaaaaacgtagaccgattgccacaagcagtcggttttttgttatactaatagtaagaaatgacaaggagaaaaacgaatggcagatgtaagattatatatttctcgtcacgggaaaaccatgttcaataccattgggcgcgtgcagggctggtgtgatacgccgctgaccaaggtcggtgaggaaggaattcgtgaactgggcttggggctcaaggatgcgggccttgactttaaactagccgtatccagtgatctgggtcgaaccgttcagaccatgaccatcgcccagcgtgagttaggaattttagggaaaatcccttattaccaagacaagcgtatccgtgaatggtgtttcggtagttttgaaggcatgtacgatgccgagcttttccaaggggtcctgcctcgtttgaaagggacagttgatgcgacgggtatgtcctttgcggaaatcgcagcaggtatccaagaagcagacaccgctggctgggcggaatcgtgggaggttttgagcaaccgtatcttgacaggttttgaatccatcgcccaggacttggaaaaacaaggcggaggcaatgcccttgtggtcagccacggtatgactattgcgacattggctcatttgttagagccagagcgtggtgccaatgtctttctcgataacggctcaatcaccgtcctcaaatacgaaaatggcaagcttttaattgaagcagttggggatttatcctaccgcaaacgtggggcagagttgattgcccaagggaaataagatataaaatcagggaggattctctgattttttttcttgacatccaccattctaggtcctcagactgatttttagcactctaagcaaaagagtgctaattttttgtctttttctcttgacaatccattttttcggcgtataatgggagtataagtaattagcactcgatatcatagagtgctaacgctcttcaaaaatcaacactatccgttgtcagcttgcctttgtgaaccacagttctacattcggcctcgcttcctaggctactgtcgattttcgctgagcgtaactaaaacagtgttcatgaaaggagcggagatgattacccaacgtcaaaatgatattttgaatctgattgttgaattatttacgcgccatcatgagccagttggttctaaggccttgcaggaaatgattgcttcaagttcggctaccattcgtaatgacatggccaagctagagcagttgggtttgctggaaaaggcccacacatcaagtggtcgtatgcccagtcgggctggttttcaatactttgtcaaccactcgctcaatctgaaacacatcaatgaagaagatgtttatcaagtggttaaggcctttgactttgaagccttcaagctagaggacatcttggagcgagcaagtcaggtcctagcggatttgacaggctacacctcggtcattttagatgtggagccgaccagtcagcagctgacttcctttgacattgtgcagctcagtagccacgatgctctggcagtcttgactctggaccagtccaaacctgtcactgttcagtttgctattcctaagaacttcttgactagggatttggaagtgctcaaacgcttagttgatgagcgcttcgttgggcagacggtcttggcaatccactacaagttgcggacggagattccccaagtggtgcagcgttactttgccacgacggacaatgtcttggatctcatggactacatcttttccaatcttttccaagaatcggtctttatcagtggaaaagttgcctcgctgacctacggcaatcttgccacctaccaactcttggatagtcctcagttattggcaccagagttgcggcagggcttggctcccaaccagcagaccagcatttccgtggcggaacatagagaacctgctcttgcagatgtgacggtcattcatcatcgttttccaatcccctatcggggcatgggccagatgagtttgctcggtcctgttgacatggactaccgtaggcagatgagcttaatcaacatcatcagccgcatcctatttatgaaattaaccgattactaccgttatctaagtagtaatcattacgaagtcaattagaaggagaatgctttgtcagaagaaatcaaaaacgaagaaatcgtagaagaggttgaagcaacagaagaagttgtggagacacctgaaaaatcagaattggatttggcaaacgagcgcgctgaggaatttgaaaacaagtaccttcgtgcccacgctgaaatgcaaaatatccaacgccgtgcaaacgaagaacgccaaaccattcagcgttaccgttcgcaagacttggccaagaaaatcttgccgagcttggataacttggaacgtgcccttcaagtcgaaggcttgacagaagatgtcaaaaaaggcttggaaatggttcaagaaagcttgattcaagcccttaaagaagaaggggtggaagaagtcgcaacagatgtctttgacccaaatcttcacatggccattcaaacagtcccagccacagacgattgcccagcagaacacatcgcacaagtcttccaaaaaggctacaagctgcatgaacgcttgctgagaccggctatggtagtggtgtcggaatagtcgctctgctatttcccaaaaaagaaaacctgaccgaaatgtcattaaactaggctaaattgaacataaaaagtaaattaaaaagaggtaacacatatgtctaaaattatcggtattgacttaggtacaacaaactcagcagttgcagttcttgaaggaactgaatcaaaaatcattgcaaacccagaaggaaaccgcacaactccgtctgttgtgtctttcaaaaatggtgaaatcatcgttggtgacgcggcaaaacgccaagcggtaaccaacccagataccatcatctctatcaaatcaaaaatgggaacttctgaaaaagtttcagcaaacggtaaagaatacacaccacaagaaatctcagcaatgattcttcaatacttgaaaggttacgctgaagaatatcttggtgaaaaagtaaccaaagcggttatcactgttcctgcttacttcaacgatgcccaacgtcaagcaaccaaagacgctggtaaaatcgctggtcttgaagtagaacgtatcgtcaatgaaccaactgcagcagctcttgcttacggtttggacaagactgacaaagatgaaaaaatcttggtattcgaccttggtggcggtacattcgacgtatctatccttgaacttggtgacggtgtctttgacgtacttgcaacagcaggtgataacaagctcggtggtgacgactttgaccaaaagattatcgaccacatggtagcagagttcaagaaagaaaacggtatcgacttgtcagctgacaaaatggcccttcaacgtttgaaagatgcagctgaaaaagctaagaaagacttgtcaggcgtgacttcaactcaaatcagcttgccattcatcactgcaggtgcagcaggtccacttcacttggaaatgacattgactcgtgcgaaatttgacgaattgacttacgaccttgtagaacgtacaaaaattcctgttcgtcaagccctttcagatgcaggtctcagcctcagcctatcagaaatcgatgaagtaatccttgtcggtggttcaactcgtatcccagccgttgtggaagctgtaaaagctgaaactggtaaagagccaaacaaatctgtaaaccctgacgaagtggttgccatgggtgcggcaatccaaggtggtgtgattactggtgatgtcaaagatgttgttcttcttgacgtaacaccattgtcacttggtatcgaaacaatgggtggtgtatttacaaaactcatcgaccgtaacacaacaatcccaacttctaaatcacaagttttctcaactgcagcggacaaccagccagctgttgacatccacgtgcttcaaggtgagcgtccaatggcagcggacaacaagactcttggtcgtttccaattgacagacatccctgcagcacctcgtggtattccacaaatcgaagtaacattcgacatcgacaagaacggtatcgtttctgtaaaagccaaagaccttggtacacaaaaagaacaaactatcgttatccagtctaactcaggtttgacagatgaagaaatcgaccgcatgatgaaagatgcagaagctaacgcggaagcagataagaaacgtaaggaagaagtggaccttcgtaacgatgttgaccaagcaatctttgcgactgagaaaactcttaaggaaacagaaggcaaaggcttcgacgcagaacgtgaccaagcccaagctgctcttgatgagttgaaagcagctcaggaagctaacaacttggacgacatgaaggctaaacttgaaaacctcaacgaaaaagcccaagcccttgcagtgaaactctacgagcaagccgcagcagcacaacaagcagccgcaggccaagaaggtgcccaaacagctaacaatgcagatgatgatgtggtagatggcgagtttactgaaaagtagtactcttcgaaattcttcactaggcttcgttaactctcctcgatgaactccagttcaatcttcgtccagttgcctagcctagtcttgaatttctttgagtatctagaacaaggaaagttatcttttttccgtagttcttagcttgaactcagttctcctcttcccgagaatagaaattattagttaataaagattccaatcacagaggttgcaacccagcctctgtttttgggtaaatacccgtctaacttttacagaaaggaaagtgttcgtaactgaacacgggctactttctgagtttcgtctattatttaacgaaaggaaatgaactcgccctaaaagctgtgtgaaaaagataaatcgtctagaaaatcaggattttctgccgatttcctattttcactttgcttttaacgggcttggtatcttatatgaacaatactgaattttacgatcgtcttggtgtttctaagaatgcttcgccagacgagattaagaaggcttatcggaagctttcaaagaaataccatccagatattaacaaggatccgggtgcggaggataaatacaaggaggtccaggaggcttatgagaccttgagcgacccgcaaaaacggtctgcctatgaccagtatggtcctgctggtgctaatggaggcttcggcggaggagcaggtggctttggtggtttcgacggagcaggtttcggtggctttgaagacattttctctagtttctttggtggaggtggtgcgacgcgcaatcctaatgcacctcgtcaaggggatgatttgcaatatgcggtcaatttgaaatttgaagaagcgatttttggtgtggaacgagaagtttcctacaatcgtgaagcaacttgtcgaacctgtacaggttcaggtgccaaacctggaacaagtccggtaacctgtgggcgttgtcatggttctggagtgatcaatgtggacacccaaactccacttggaaccatgcgtcgtcaaatgacctgtgatgtctgtcatggtcgcggaaaacaaatcaaagacccatgtacaacctgtcatggaactggtcatgaaaaacaagcccatacggtaacggttaaggtgccagctggtgtggaaactggtcaacgtattcgcttggctggtcaaggtgaagctggtttcaatggaggtccatacggagatctctacgttgtcattcaggtccaaccttcagacaagtttgaacgtgaagggaccaccattcactataaactgaacctcaactttgtccaagcagcacttggagatactgttcatgtgccaacagttcacggtgatgtggatatggtcattcctgaaggtacccagactggtaagaccttccgactcaaaggaaaaggtgcaccaagtgttcgtggtggagctattggtgatcaatatgtcacagtaaatatcgtcactccgacaggtttgaatgaccgccaaaaagcagctcttaaagaatttgcggcagctggaaatattgatgtcaaaccccataaaaaaggattttttgacaaggtaaaagatgcctttgaggatttataattctaagatgagactgggcaaaaagcccaggaccactactcagagttcgtttcaacatctcagcgcagtggttgattggcagatttgttcgtgttttgcactccaaatctggcctaatcaactgtgcgggggtgggaagacgaactctttttatcttggtcgagttctttcccactcccctttctttttcagaaaaaactctgggcattttctccgacgcatcacaggctctgtgttaaaataagatatagtaatttgaaagagaacgcttacgaatgaaatcttgggttgagaatgtgaccataaagaaatacgaagatcggtctggcttgacgggtttgaaacaggagccactggtgtggactgaggtctttttgcgcgaggtcaatcgtcagtccaatacaggaattttacatttttggcccatggaccaaacggtcattctggggatgatggatagtcaggttgcccagctggacaagggcttagccagtattggtcaggcaggctacagtcctattattcggagtttgggcggtttggcagtcgttgcagatgaagggattttaaatgtcactctgattttgtccaatccttctggtcacaaggttgatttgcgggagtcttatcaggtcatggtggatttgattgcccaggcactttcagattttccctttgaggttgtcagtggtgaggtggcaacttcctactgtccagggacctacgaccttagtatcaaggggcggaagtttgctggattggcccagcggatttaccaagaggctattgccatttctgcctatatcagtgtgtcaggtaatcaagtcaaacgtgggcaagtggtggcggatttttatgtggcaagttttgctccgcaagaagtatcggacagatttccgcaagtaaatccggattcgatggccaatctgtcagacttggtcggtcaggatgtgacggtggaggatatgaagaaacggattgagcaagtattggttgaaaatgggaccaggctgtctactttttatccctcgtcggacaacatggctgattttatgacctttggaaagaccatcaagcagtctatggaaaaatatggtatctaggagattcttatgatatggaaagatgcgacagccatggctcaggctgtcaatcaaaaacaggtttttgccaaggaattggtgcaagaaacgattgacaggattgaaaagctcaatcccaccctcaatgcggttgtcagcaagcagtatgaagaagccttgaaagaagcggagaaagaagactatctgggcaagccatttgctggagttcctttcttgttgaaggatctggggcaaaatgaaaaggggcagccatcttctgctggttctcgcctacttgctggtcgaccagcaggccataccgacacctatgtccaacgcttgaaagatttgggtttcatcatagtcggtcgaaccaatacgccagaattcggcttcaaaaatatctcagacgccagcctgcatggtcctgtcaatcttcccttggaccccagtcgcaatgctggtggatcaagtggtggtgcagctgcagcactggcttcaggcatggtctctattgctgcagcatcggatggtggtgggtctattcgcatcccagcctccttcaatggcttgatcgggctcaaaaccagtcgtggtcggattccagttggacctaagtcttatcgtggctggcagggagcatctgtcaattttgccctgaccaagtctgtccgtgacacccagcgtctgctctatcattttcaggactaccagctggaagctccttttccccttgccaagctgagtgaagaggaggtttttggaaaattgtctcgccccctaaaaatcgcctactataccaaatctccagtagggagcaaggtcagtcttgaagcggtagaagcggttcaaaaagcctgtcatcacttggcaaatttggggcatgaagtggtggaattaacagaatatcctctggatggagtggccctgatgaaatccttctacctgatgaacagcgtggacacggcccagatgtttgacgaaatcgaagcagcttttgggcgccagatgaccttggatgacatggaagtcatgtcctgggctatttaccaaagcgggcaaactattccagccaaattgtactccaaggccctattggactgggaccagtttggagccagcatggcgcgtttccatgaggaatacgacttgctcctgacgccgacagtggctgatgtagcgcccaagcatggacaatttgacctaccagtagatttgctggatcgcctcaagcagacccagaactattccatggaagagcagcaggacctgatctggcaaatgttcgaggacagtctggccttaactccctttacgcagcaggccaatatttgtggtcagccagctatttctctgccaacttatgtacgtgctgacagcctgccaatcggcgttcaattgacagcatccaagggacgagaggatttgctcttgcagttggcagatcaaatggaggcagctggtttactcaacttgtaagggaattcattttttcagttcaattatttgccaaaacgttttcaaaatgttaacctgtaaaagttggtgggttaacaccgaaaaagtaaaaaaggaagctatggcttccaaaggagattgttttatgttgaaaaaagttttagcctcagctctcttggtttctacattgaccttggcagcatgttctagttcaagttcgaatactagcagttcttctgctgaacagactcaatgggaaaaaattcaagaagctggtgtcttgaaagttgctacaccaggtaccctcttcccaacttcttactacaatgatgctaaagaattggtcggatatgaaattgacatgatcaatgaaattggtaagcgtttgaaactggaaattgaataccaagaaatcggtgtggcagaagcctttacagcggttgacagtggtaaggtagatatttctgttaacaactttgacatgacagaagcacgtaaggaaaagtacaacttctctatcccttacaagtattcagttggtggctacattgttcgtgaagatggttcatcaggaatcgaagcagctgacttgagcgactggactggcaagaaagctggtggtggcgctggtactcagtacatgaaaatcgctgaaaagcaaggtgcagagccagttatctatgacaatgtaaccaacgatgtctatttgcgtgatgtatctacaggtcgtacagacttcattccaaatgattactatacacaagtgatggctatcaaatgggcaaatgccaacttcccagacatcaaggtaaaaatgggtgaggctaaatacaacccaactgaacaaggtattgttatgagcaaggctgacacaagcttgaaagaaaaaattgacgaagcacttgaagcgatgaaagctgatggaactttgaaggcaatttctgagaaatactatgcaggacaagacttgacagtccctgttgaaaatgctgataaattgccagttatcgaagttgaataagacctcgtaacaaattaaatgcatcttgtatagactttgtcagtcacagactggcaaggtctatctggtttttaggaaagaggagaagatatggatattaactggcaggcagtttttaatgcagatattgcaagagaggctattccacagattttggagggacttccctacactctatccctatccctaattggttttgccttggggactttctgtggattttttgtagccctcatgcggatgtctaagtttggacccttgcgttggttggctatggcccatatttctctcatgcgtggaattcccctcatggttcttctctttttcatctattttggattgcctttcatggggctacaactagatgctatctccgcatctattatcgcctttacctccatgtccagtgcctacatttctgaaattattcgtgcatctctttcggccattgataagggacaatgggaggcagcgcgttccctgggcttgcggaccaatgtgattcacagaaaaatcattattccccaagcctttcggattgctcttccaccactgagcaatgttctcttggatatggtgaaaagtacgtccttgaccgctatgattactgtaccagagattttcaataaggcaaaaatagtcggtggagctaagtcggattatatgacggtttatatctgtgtagccctcatttattgggttatctgtaccctttatgcatttggtcagctcaagctagaaaaacgcttggcgacttactaaaaagaggttggtttagccttccgattaaaatttgaacaatcaaaaatagcttagaattaacgtctcgaatgatgtggacctaagctattttttattttaaagactgttttttcgatgtaactctcactcttccacatattccaaaatatcccctggttggcagtctaagatgcggcagatgctcatcagggtattaaaacgaatgccttttgccttgcctgtcttgagaatggacagattggcttcggtgatgccgacttgctccgccaagtccttggaagtcatttgtcggtctttgaggaccttgtctaagtttacgcgaatcatttccatatcagataaactcgctgttctcggtttcaagttgttgccccttttgtactaaggtccagacaaaataagtcaagaagataaagagggcgttgaggatgaaatctgaccaacgcagattgaggaagttgtttggtccagcagcatttgtcaaggtgatcaagctggttaggcaaaattgcccagcagtcaggacgagcaaactgatgaagagcttctgataaagttccatactagctgaagcgaaataatcttcttccagaagcaatttacataacttttgaatcaagtgggcaatgtgactgagtgctactaagacaactagaatcaatccagtcgctagcagaatgagccagacactgatctggtcaatgggtttgttaaaggtgtattcccaagagcctatcgcaaaggagtcgcctccaagaccagccaggctaaagaaaatatagcttgcaattaataaatagaagaaatagcgaacacaagcagccacaatgccagctgttttgagtagattggttttcatagcaaacctccgattattattgttttatgataatattatctgtaaaattattataaaacaataatttttgaaatgcaagcgtttttttaaaaaaagaataataagaaaaccgccaactacctggcggtttgaagctatttaaaatacaatagtctcaacccattcaaaatcaccaaaatcgttgatccttcgtggcccaccacaccgagtgggaggttgatagactggaagaggttggagatgataagaagggcaatgacagatagcgcaaagatgatgttctgcttgatgatgccccgcattttcttagagagacgaatggagtaaggaattctcgtcaggtcttccatgagtacgatgtcagctgactccatagcgatgtccgttccgcttcccatagcatagctgacattggcttgagccagggcgggagcgtcgttgatgccgtctccgaccatgccgacagacgcaaactcggtttgtaattcttggataacagcagccttatccgtcggcagacagttggcaatcacacggtcaataccgacctgactcgccacgtaacgagccgtcttttcttggtcacccgtcaagagaattggcgtcacgcccatttctttcaactgggcaatcagctgcttgctctcaggtttcaaactatcttccaccatgaagatcgccaccagcacatcattttggctgacatagaccagggttttcccagtgctttccgcctcatcgatctgtgccagcaagccagcagacaggggactcaccaggctgtccgccacaaatcccgccttaccgattttccagctgtcgccctcatagcctgccaccaagccttttcctgtcacgtcttctaggctttgaagggcaatagcagagctgtcagccgtataggtcatgagagcctgagcgattgggtggcttgattgtttttcaactgcctgaacaacctgcttgataagctcttcatcgccaagataggtcgcacctacaacttcaggtttaccaatggtcagggtacccgtcttatcaaagacgatggcctctagattggcgatgttgtccgcaatgtcaccgcccttgataatcatgcccttacgtgccgcacggctgatggcagaaagtgttgcgggtgaagaagaagctacgagggcacaaggagaagcgatggttaagagaatcatgcctcggtagaaggcagttaaccagtcccagcccagtgcaaaatgagcaaggaggatgaagagtggtaccaccaccaagacaaccttgacataggtatcttccatattttcaatgaaagtcgctgtttttgatttggattcttgggcgttttcaaccatctggacgattttatcgaagagggcatcgcctttttcagccgtaacttgtacggtcacagttggaccttggttaatggttccgccgataacagcatcgccagccattttctccgcagggagcggctcgcctgtaatcatggattcgtcaaagatggattgcggactgatgagggtagcatccagtggaaccgtgtcacccttgcggacttgcaggaggtcgccaatgcggatggctgcggtgtctaagacagtaatgtcaccattttcctcgattttgcgagctgttggaggggtcatgttcatcaaagcagcgatcgcattcttgcttttttccatggctaattcttccagagtagaagaaagggagaagatgaagatgagtagagccccctccatccagtagccaattagaccagagccgatagcagctaaaatcatgagcaggtcgacagacaggtgcttgtcgaaaatcagctcagaaatgccttccttggctgattggtagcccccgatgacaaaggctgaaatgaagaggataggagcccatccctgtccagtctgaaacagaaggatacctattagaatgagcgccaagcaaagagcggtcgtgatgatgtggctgtgttgtttgaggttggttacgagtgtcatagtttgctcttccttatttataattattatcatttaactaagttaattataacaattataaaaagaaagtcaagttatttataataattctaaataatatcattctgataattcaaagggaaataaaaaaaagcgacagaaagccgctttgatattcgtcttttagttctggcaatcaggacaaatgccgtagatggatagcacctcttttgtaattttgtaaccagtttgggtatgagcttccttcttcaagctcgggatttctacatccatgaaatcagtgatttttccacagacttcacaaataacattgaggtgctcgtgccccataaagtcgtaataagtagtattatcattggtccgtttcaatttggtcacgaacccttcttccaatagaagtttgaggttgttgtaaacagtcgccagactcatgttggggtagttaggtattagatcttgataaatcatttcagcactagggtggtcatcgctttcgataatgtaggcaacgactgcttttctagtttcggtaatgcgtatacccttttcttttagatgttggatgacgtgttcaaaagcagtttggttttctgcattgaagtgagaatggagttccatagtttcctcctttcgttattattttataaaaattctaagatacaatattcagtttcattatagtgtatttgggaggttgtgtcaattttgagacaggaaatctgtcatagtacagtttggtgtctcatgacttgtttacatacttttcctgtgctacaatcaaaacatgacaagatataaggcaattatttcctacgacggacatgacttttctggttttcagcgccagccccatgctcgtacggttcaggaagaaatcgaaaaaacgttagtaagattgaatagtggtcagccagtaaccgttcatggtgcaggtcgtacagatgcgggggtccacgcttacggtcaggttatacactttgacttggctggcagtcgagatgtggagaagctccgctttgccctggatacccaaacctctgaggatattgatgtggtcagtgtggagcaggtggcggatgattttcattgccgctatgccaagcacagcaagacctatgagtttctggtggatattgggcgacctaagaatcccatgatgcgccactatgcgaccttctatccctatgatttggacttgagcttgatagaagaagccattcaggacctagtgggaacccatgatttcacaggctttacggcttcggggacctcggtcgaggacaaggtgcggaccattacagtagcaagtatggaatatgaccagcagcggcagttcttgattttcaccttttcgggcaacggttttttgtacaagcaggtgcggaatatggtcgggaccctcttgaaaattggcaatggtcgcatgcctgttgggcagattaaaaggattttagcagaaaaggatcgtggtttggcgggtccgactgcggcaggcaacggcctctatctaaaggagattatctatgaagactaagtatattttggcgctttctggcaacgatattttcagcggtggcgggctccacgcagatctgaccacctacacagtccatgggctgcatggctttgtggcggtgacctgcttgacagctatgacggaaaaaggttttgaggtcattccgacggagactgcggtctttgcccagcagctggctagtttgaaggatgtgcccttttctgcgattaagattggcttgcttccctctgtggaaatagcagagcaggctttggagtttatcaagactcaccaggagattcctgtggtcttggatccagtcttggtctgcaaggaaacgcacgataccgaggtcagtcagttgcgagatgaaatcttgaaattccttccttatgtcagcattatcacgccaaatctggcagaagctcagctattgctccaaaaggatatcaaaacggtggaagagatgaagcaggtggcagtggccttgtatgacttgggagccaaggcggtggtcatcaagggaggcaatcgtctgggtggctcagaggcggttgatgttttctacgacggtcaggaagtggtggtgctccagtcgcctctgctgtcagaaaacaatgtgggggcaggctgtacctttgcgtccagcattgccagtcagcttttgctgggtcaagagcctttggaggcggtcaggctgtccaaggactttgtccatgcggcgattgaaaaatcagatgattatggggtggttcaatatgagaaataaacaaacgcaagaattggtcttgctcgctatcttaacagccttgagtttggtattagcctttgttcatgtaccaactgcaactggttttgtcacactcttggatgttggggtatattttacagccttttacttgggcaagaaagagggagccattgtcggcggattgtcagggcttctgattgatttcttgttgggctatccccagtgggcattctttagtctagtattccacggggctcagggttattttgcgggttggacaggtaagaaacggattctcggtttagtcttggcgaccctctctatggttgggggctactacctggcatctcgactttattttaatgacctgaaagccattgaaagtgttctaagcaataccttgcaaaacacagttggtttggtagttggttacgtcttggctcaggcaatagaaagaattggtgcagtaaatcatgttattaagggaaattaaagaccaaactaagcaagttgtgcaagaagtcctagaactcagcgatcttcaaaaaggacagatatttgtccttggattgtcctctagtgaggtgattggagggcatatcgggaaaaattccagtctggaagttggtgaggtggttgttgaaaccatcttggaaattctggatcaaaaaggtatctatctagctgtccaaggctgtgaacacctcaatcgtgccttggtggtggagcgtgaattagcaatccagaaggacttggaaatagtcaatgtcttacccacccttcatgcaggtggttcaggacagctggcggccttcaagtatatgaaggacccggtggaagtcgagtttatcaccgctcaggctggtgtagacatcggcgacacagctatcggcatgcacatcaagcacgtccaagttccgattagacctagcctgcgtgaaattggacaggcccatgtcacagctctcgccagccgaccaaaactaatcggcggagtccgagcagcctatcaggaagatgagatacggaaaggttcataatgaaagaatttacggttaaggatttagtgtggacccgtccaccgagacaattcactatttcagatgaagaaattaccattaccacccacccccagacggatttgtggcagaagacctattaccattttgtgaatgacaatgctcctgtcttacagatggagacagaggaggactatttttcttttactgtgaagacggattttgcgggtagtcatactcgatttgaccagtgtggaattgtcctttatcaagattcggagaattggctcaaatgttcgatagagtatgaaaatgatgacttccaacacttgggaagtgtggtgactaatcacggcttttctgactgggcaactactgaagtcagttcacaaatcaaatccatgtggtttaggctcagtcgcaggggagctgattactgttttgaaaatttcgaagatggtatccacttcaaacaaatgcgggtttgccattttcatcaaggggcggggaaaatagcttttgggctatatgcctgttcaccagaaaactccagttttacagctcgctttaccaatatggaattgagcgactgcaaatggcaggcccatgatggccaagagccagatgaaatatagtgagagttttaggtaagtagtaacagaaaaatagttgaaactcatactcttcgaaaatcaaaatgttccgttgtcaacttgccttgaagaactcctgttcaatcttcaccttcgtttcctaggctacttttgattttcattgagtatcaggaagtaactttcgactagtaagagagttactttttttatcttttgagccaaatccttgccaaaaaagtctggcttttgataaacttgtttctgtaaatgatacaagaacaaaaggagaagacatgacaaaaggataccaacaacgattttcactgtccattttattatggatgcgtcaggataaagcacgccaagagggaatggactactggagtggcgggcatgcacagattattgcagcttcaccgggtctattagaataccgccagcaacatttgagtgagacagaacatagtttttggccgaaagcgacaggcttggaaacggctgttccagaagatcgtcggattgatggcattgcggaagtgacctatcaaaagttattggcaccaataggcggtcgccgtcagacggccctggcctttgaagatgaggtcaatgttttccgtcggactttgatgcacatgggcttcccttattcatcacgttggtaccatactagcactcaggcccaaacccaactgcgtgatgtcctatacttccgtcgcaaagatggggtgaagagcggtagcttcaaaaaatttgttcaagatggactcgccagtcaactggcgacaatctctggggtaacggaagtacgaacacaggtctatcttccttggaataaagcgacttggaataccccaaatgttgcccatgacaatcctaaagaagaccatcttcatgcctccatcatcccaggttttgcggatcaggcggcaagagaggccttctatgccaaccaggctccgcagttgaatgcagaagtggtgcaatactcctcagcagtccacgcttatcatatagaaaaaaccttgccatttgtcctagacggcaaacgcatgtaagacaagcgacttcttggtcgaatgctttgttaaaaaaatatagtcgaatgaattagctttcagacaaggaaccgaggtgcaggttgctagcacagcctagtggctgtgctaggttggagatataacttgcaaagcaagtcacttctgcagagtacggcaagccgaaagtgacgatgtatcaaagttaattcaaatgactataaagcaaaagacttgccaagaagtctagcttatggtaaacttgttcttgtaaatgatacaagaacagaaaggaaaccagatggatacaaagttttcagtagcccttcatatactgaccatgatcagtgagagtaaggaaatacttagctcgcaagccttagctgagagcgttggcaccaatgccagctacatccgcaaggtgattgcacttttgaaaaatgcaggcttaatcacttcgcaccaaggccgttcaggctaccaattgagcaagtctcctaaggatattagcttattggaaatctaccttgcgacgcaagaagtggagcatattcgcctatttcagatacaccagaatgccaatctttcttgtccggttgggcagcatatagaaggcgcaatggttcccatcttttccagcgttgaacaagaactggaaaatcaactcagtcgtcaatccttagataatgtgattactaatctctatcaatccgcacaagtaacccgaatctgacctcggtcagattttataaactcaaacatagacctgtaagtgatacaggaacaaatgatataatagaaaagagaagaacatgaaagcagcacaacacacatcttataacaaaaacaacatcgcccttaaccttacagaaattgctaagccacaaatcaagcctaaccaagtccttgtcaaagtgaccgcagcaggcgttaaccccttggacaacatgatttcacgcggagatgtgaaattgattgtcccttacaaattgccccaaacagctggaaatgaagtggttggcttggttgaagaagtaggttcaagcgtgacgacctttgcagcaggggatcgtgtcttcggtcgtcttccgcttgatagtatcggtgcttttgctgagtatgtagcggttgacgctcaggctcttgctaaggttcctgcctacttgacagatgaagaagcagctgccgttcctctgacagctctgaccatcatgcaggcacttgaccttatgggggcacaatctggcaagaccatcttcatctcaggcggaactggtggtgtcggaggtatggccattccgattgccaaagccaagggcttgaccgttatcacaaatggtgatggggcaagtgcagagcgggtgttgtcattgggtgcagaccgttttatcgactacaagacagaagattacaccaaaacacttagcgatgttgactacgtcttggacacacttggtggtgcagaaacagagaaacaaatgtcaatcatgaaaaaaggtggacagctggtttcccttcgcgccatgccaaatggcgaatttgccaaacgtatgaatttgccaaaatggaaacaaatcttgtttggcctagctggtcgttcatttgacaaaatggcaaaaaaatacggtgttcactaccatttcattttcgtagagagcaatggtcgccaactgcaagaagtagcagacattttcaacaagctcgaaatcaaaccgtcaatcgatacagtttatccatttgaagaagtcaacgcagcacttgataaggttgccaacggtcgttcacgcggaaaaacagtcctcagtttcaactaaaaaataaaatatacagggaaaaatcatgtcatatattacaaccaaaaaccaatacatcaccgtttcaaacaataaaatcgcctatcgtgagctcagcaagggcaagtctgacattcctttggtcatgctggtccacctagcggccaccttggacaactgggatcccaaattgctggatttgctggctgaaaagcaccatgtaattatcctagaccttcctggcgtaggagctagtcaaggcaaggtggctccgactattccaggaatggctgagcaggctgttgctattatcaaggctttgggtcatgagaaaatcaatttgctgggtctgtctatgggtggttttattgctcaagaaatcgttcgtctggatagtcagctggtcaaccgattgattttagcaggtacaggtcctcgtggtggttttgaagttgataaggtaactggaaaaaccttccgctatatgctgaaggctggtttagagcgtgtggatccaaaacgctacattttctacaatcatgatgaagcaggtcgtttggaggcagaaaaagtcttgggtcgtatggggcaaagaagtgctgcacatgcagacaaggacatgaatgttccaggatttttgacccagctgaaagctatcaaacgctggggaagagagccgcaagatgacatgacctttattacccaaccaactctgatcgtcaacggtgataaggatatgcaagttccgacagaaaattcttataccatgcatgaaaaaatcaaaaatagccaactgattatttatccaaatgcaggacacggctcgatcttccaaaatgcagaagagttttcaaaagccttactagcctttttggaggaaagcaatgcctaaaactattttaatcacaggatcgacagacgggattggcaaacacctagccatgaaactagctagtgaaggccatgaagtgattttgcacgggagaaatagcgaaaagctccgtgtagctctcagtgacattcagctaaaaacaggaagtaaaaaaattcatggctaccttgcagacttttccaagttagcagatgtctatcgtttcagccaagaaattaaacgcgattttgagcagattgatgtcttgttaaacaatgcgggtgcttactttggtgatgcgcgtgtagcaacggcagaaaatatcgagatgacctttatgctgtctgtccaagttccgtatatcttgacgacggagttacttcccttgctggaaaaagcagcaggcagggtcattcatacctcttccttgatgcaccattttgcacaaaccagaggcttggattttggtttagagcagagctattctgcagccatggcttacaataatgccaagctttacaccatttggctggcaatagctcaggcagaggccttagaaaagcaaggttcatctgtgaccgtcaatgcctaccatcctggcttgattgcgacaaatttgggcaatgatggtatcaaacgcaatctgagaagtcggattctcaccagtctgatgaaaccattttccaaggatttggaccaggggattgaaacgggttactacttaagcttgtcaccagaggtggctggagtatcaggtcgttattttgcggagaaaaggttggctaatgtcagcttgaaaggatttgatttggcaaagagccaagccttactagcctatcttgataagaaaattcaagtatttaaggagagctacggtgactaagattttgttagaaaacctccaactgcccaatggtcaggtcttagacaatcgctttttcaaatccgctatgagcgaaaccctggcagatagtcagggagctccctcagatgacctgattgccttatatgatttttgggccaagcagggagtgggtgtcttagtgacaggcaatgtcatggtggacggccgctaccttggtgagccgggcaatgtggtccttgattcagacgctcatctggctcaatttcggaaatgggcagccgttgggaaaaagaacggtgtgcctatctggctccagctcaatcatcctggcaaacagatgtatcggtcgatcaatcaaactccgattgcacccagtgccattccgatttctggaggttcagcttcggcctttcgtccaccgagagaaatgactgtgtttgacatcaaagaagccagagataaatttattgcagcaggccttagggcaaaagcagcaggatttacaggtgtacagttacacgctgcacatggttacttgaccaatcaattcctctcaccagcggataatcagcggacggaccgctatggtggcagtctggacaatcgcatgcaattcttggtggaagtttatcaaggtctgcgtgaaaaagtgggaccagattttaccattgccttgaaattgaatgcttctgattttaaggaagagggttttggttttgaggattgtaagcatgtggtgaaaatcatgtctgacttgggtattgacctgattgaaatttcaggtggcaattatgagacacctgtttttggtagtgactatgagaatggtgctggatttgtcacctatgcccttgctctagcagatttgacttctgtttctattgtttcaacaggcggtttccgaaaagtcactcagatggaggaggctatcaaggatggtgtgtccatgattggtcttgctagaccctttgtccttcgtccaagtcttgtcaatgattaccgtcaagtcggtgatttgcaagcagacggcgaacggacaggtcgttatattcttggcggtgaagagttggtcttgaacagcaagggagaaagcgttatttcctatgcagattatgccattggtatgattgacgagattgcaacaggtgatcatctcaaagcacgtatcagccttgtcagtgagtaaaagattgttatgcagatttcaaataaatttaccattgccattcatgccttggcttttatccatctctttcaagaccagcaacgtgtcaccagcaaggttttggcaaacagtattcaagccaatcccgttatcattcgctcggttctatctggtttgaaggaagcgggaattgtagatgccaagcagggtagcggcggttttcgtttagcaaagacgcttgatgacattagtctttatgacatctttgttacggttgacaatattgataagaaaggcttgttcaactttcatgaaaatccccatcccgactgtatcgtggagggaaatatccatgctgctgtggacgacaaactcgtccaagtccagacagctatggagaaagaattgaaaactatgtatatgtccgatgttctggttgacctagaaaaagccattgaagaaaaagtgaaaaggatttaaatgggagtgggaaagaactcgaccattcatagaagagttcgtcttcccacccccgcacagttgattaggtcagatttggagtgtaaaacacgaacaaatctgccaatcaaccactgcgctgagatgttgacacgaactctaagtagtggtcctgggctttttgcccatcctcactatacacaaaaagacttagagtgactgaacatcagttgtctaagtctttttgcttggtttggtcaagaacgttgacaagcttgctctattgctcactcatcaaccgcatgatgtcatcagggctttccttacagcctcgagcaacccaggttttgagcactcggaaaaatcctcctacgataaattgcaggtgaaaatcatcagtcaagtcccccagtttttctttgaaatagcgatccaagacctcctcgagcaagtagtccaaatggttggcagtcaataagcgaatcttatcctgttgctcataccaaaagtcaaaaaattgccgtaaagctagtaagagatgagcatctgaccaatccgacaagtcaatctgccgttcggtcaaccaggcttgcgattccaagttgaaggatcgttcgagcacctcttccttattggaaaagtttcggtaaaaggtcacccgaccgatgccagctcgctccaccaactctgacacactaatcttttcaaaagatttgtcttccagtaactcccacagagcctccacgacactctccacaaataatgactctttccgcttcactctttccatgcgaaacacttcctttcctttgtttccttttggggaaatagcagagctgggactagttttcccactgtccatctgctatactgataaaaacgaaacacttgtttctaaaaatataccataaaggacagaaaaaagaaagtatgaaaaaagttttaatcggcattgggattttaatagcttgttttggtattggtttcctgtatttagccagcaagccatcagtggcttctaactacacagaagtagttgaaacgggtggagctgttgagaaaaagtatcttggacagggcaactatgacgtttcctatctcgaaatcaatgctttacaaaatttcaaaaaatatgaactgtactatcctacaaatattgaaacagaaaccagaaaatttccagtagtgatattttctaatggtaccggtgttagagcttctaagtatgcgtctgttttgaaacatttggcttcttggggctttattgtcattggtactgaggaagaatattcttggaatggattttcatccgaaatgagcttgcgacttgctatcaagctaaatgataataagactgttgaaggcctaaaatcaaatcctttctttagtaaagtcgatttagataagatcggcctatcggggcattctcaaggaggagttggggtctttaatgctgttacggaacaaaagcatgggcatatgatcaaaactatttacgcggcaagtcctgccaatttagaactttctagtaatttagaatgggactatgacccgagcttgatttctgttccgacctttctagtatcgggtacgggaggtggatatgaggatttggtagtgtctggcaagcagttgacacagatttatgagacattaccagctaccatcacgaaggtaatggctcggagaaaagaagcaggacatggtgatatgcttagacttccaaacggctatatggtagcttggtttatgtggcggttacaaggagcccctgaagcagagacggcatttcaaggaaactccccagaaattgttcaaaacaaactctatcaagatcaaagaataatgaactaggatttgtatcattgacggtcaaaagcgagttctgtctttctattgtttgttcttgttttatgttagtagcttattcaaaaaatgtgtaaaaagagtgtaattcttcatgaaaaaattcaaaaaaatcatcttatggacccttgggattgtagccagtctcggtatcattgcttatgtgtctgttaccaatcatccgcagttggtagtcggtgtcattcaatcgtttatgtacaaagagagttcaccgaactcttacagtcctctttatgatcccattgatggtctgaaagaaaatggtcagtatttgaaaagtgagattgcctatagtaaggactatcccaacagttttttagatattacctatccagaccaaaatcttgaagctgaccgaccaaccctcttctatttccacggtggtggattctttggaggtagcaaaaatatgggggcccctctgtcagctagccaagcgacctacctcattgatgacatcgtgtcaaaaggatataatgttgtcaatgtggattatgctcttgtaccagaccaccatttcccaacgccagtgattcaaatgaatcaggctatcgcctacatgaaggaacacgctgaagaatatcacttgaacatggacaatgtcgtcttgatgggttcatcagcaggtgccatcatggcggcacaatatggtagcgtcttagccaatcaagagtacgctcagctattgaatattgaaccaagtattgcaaaagaagatgtcaaggctctggttatagacgatgctcctttagattatgccaaatttagcctaggtacgaagatcttggttggaaattatgtttcagaaaccatctatctaagtgaggaagaaatcaatgcctataaccctatttcccatgtgaataaagactacccagctagtttccttctgggaagcgaggatcgaacagatatggtgtcgctcaacaaggctttgaagcaagcgggagttgaaaatgaattggtcgatcctttggcagaagaagggcttgaaaagcctcatggttttgtggcgaatttacgaacagaccctgtgtctgccaaagcatttgaacggttgatgatttttatagacgatagaaccaaggaatagtcggagtgttgataagttggaaactgatagggatttgtccaatcaatctgtcgctctgacaaccatgtttgtactcagaaagtctacgccgaaaaattccaagtgagaacaataagtcccagctctgccatttcccaaaagtacgttataaaatcgttgaaatccttgtcaattgtgttataatgaagagtatgcaataaaattttaaggagaatgacagaatgtctgtatcatttgaagcaaaagaaacaaatcgcggcgttttgactttcacaatcggtcaagatgctatcaaaccagaattggatcgcgttttcaacaaagttaagaaagatatcaatcttccaggtttccgtaaaggtcacttgccacgtgccgttttcaaccaaaaatttggtgaagaagcactttatcaagatgttgtaaatgcattgttaccagcagcttatgaagcagcggttgcagaagctggtcttgaagtcgttgcacaaccaaaaatcgacgttgtatctatggaaaaaggtcaagactggacaatcactgcggaagttgtgacaaaacctgaagtaaaattgggtgactacaaaaacttggcagtttcagtagaagctactaaagaagtaacagacgaagaagttgacgcaaaaatcgaagctgcacgcaacaacttggctgaattggttatcaaagaaggtccagcagctgaaggcgatacagttgttatcgactttgtaggttcaatcgacggtgttgaatttgacggcggtaaaggtgagaacttctcacttggacttggttcaggtcaattcatcccaggttttgaagcgcaattggttggtcacgcagctggtgaagaagtaaacgttgaagtgactttcccagaagactaccaagcagctgaccttgctggtaaacaagccctcttcgtaacaaaaatccatgaagtaaaagcaaaagaagttccagctttggatgacgaattggcaaaagacatcgacgaagaagtggaaacacttgatgagttgaaagctaaataccgcaaagaattggaagcatcaaaagaagttgcctttgacgatgcagttgaatcagcagctcttgaattggctgtagaaaacgctgaaatcgttgaattgccagaagaaatgattcatgaagaagttcaccgtgcaatcaatgaattcttgggtggtatgcaacaacaaggtatctcaccagatatgtacttccaaatcactggtacaactcgtgaagaccttcataaacaatacgaagcagatgctgaaaaacgtactaagacaaacttggttgttgaagcagtagctaaagcagaaggtttcgaagcaactgaagaagaaatcaacaaagaaatcgaagacttggcagcaacttacaatatggaagtggcacaagttcgtagcttgctttcaccagaaatgcttaaacacgacatcgctgtgaagaaagctgtagaagtgattacaagcactgcaactgtaaaataattatttggaaaactcgactctggtcgggttttttgtttaatcatctttcgatgttacaaagaaactctctgaaaaaccttgtccgtcccatgcagaaatgggagaatgtcatatctgttggtggagtcgtccaagtttcacaaggggtacgaataactgacggagaggtcagccattaccagttgccgtggtcggtgctcccatgtttacaagctatcgaatatgactgttcttttttagggagtagaattttattggactatttgcaatccaatctcatcatatcaggtgcctttgggttattttacaaggagtatgtcatagcagttgggggttatgataggcagacactgggagaagatatggagctagtcatgaaattgcattatttctgtagaaataacaatattccttatcgaatctgctatgaaaccagcgccatttgttggagtcaagcaccgagctctatcggtgatttatgcaaacaacgccgtcgctggttcttgggactctatcaatgtctaaaaaaataccgaaaaatgttatcgcgagttcgttttggggcggtgggatatttttcctatgcttactatatgctatttgaatttttggctccgtttatagagactttcggttgtttcgtgattctactttcgttgatctatcatcaactaaacatctcatttttcatatcgctctttttcctccatagtgctttttgctcactaatcacctttgcgtcatttttgcaacgcgtctactcgcaagatttatttattggacctatggatttgtgtaaagccttcctggcaaccttgtttagatattttttcttgcattgggtattgaatattgtccgtctgacaagttttattggatataaaaagagaaagcgtgaatggggagaaatcaaacgagtgaaacaattcgtttaagtaaaggtaagactggcttataaaaagaaagtcttatctttttttaaaaaatacttgactggttaatattcttgtgttatagttaactggttaacaaaggaggaagttatgttaaagaaagtgataagaggctgttttgttgccttattcggttttgttttagcagcttgctcggctcagaaggaagcgagtcaagtacagccaggaatgaaaatagtcacctcattttacccgatttattcactggttaaggaagtgtcagggaataaaaatgatgttcgaatgattggctcaagacagggcatacactcttatgaaccatcggctgcggacataaaggccatatacgatgcagatgtttttatctatcattcgcgaattttggaatcctgggcaggacgtttggaacctaatttgcaaggttcatctgtcaaggttttggaggcttcgacaaatttaccgctgacaaaggttccagggttagaagacatggaagctggtcaagggattgatgaagctagtttatatgacccccacacatggctggatccagttttggttggtcaggaagctgttgcgattggtgaacttttagcagaaagtgatcctaagaatgcggattattatcgtcaaaatgccgcaactttagagggaaaggcgcaaaagttggcagacaagtatagcccaatctttttaaaagccacatcaaaaacatttgtcactcaacacacagccttctcttacactgcgcaacgcttcgggttgaagcagttggggatcgcaggagtttcagaggaagaaccaagtcctagacagttggcggaaattaaagaatttgttgacacctacaatgtgcaaacaatttttacagaaaaaggtgcctcggataagcttgccaaggcattggcgagttcgacaggtgtagatttaaaagtgttggatcctcttgaagcagatccagaaaataatttaacctatctagaaaatctagagcaagtcttagaaacattagctcaagagttaaaataaaaggccgaattctatcgaccgaaaggagaaaaaatgaagaaaaaagcagttgttggctccgtagccgcccttgttttagggatgagtctctgtagctatcagcttggacgtttccaagcgatggaagagcaaaaaaatcgtgtgtcctatattgaagatagtcaaagtgtgcaaactaccgttgctgaacaattaacacctgatcaagtttctgccaaggaaaatattgacgctgagcagatagtcgttaaaattactgatcaaggctatgtgacatcacacggtgaccatttccactactataatggtaaagtcccctttgatgcgatttttagtgaagagttggtcatgaaggacccaaactatgtcttacaagacagtcacatcattaatgaagtccaggatggctacgtcataaaagttgatgggaaatactatctctatctaaaagaccctagcaaacataaaaatgttcgtagcaaagaagaagtggagcggcaaaaaggaatctcttctgctgacagcaaaaatcaggcagcaggaaatagtaaggatggccgctacagaacagacgatggctatgtctttaatccgacagatgttattgaagacacgggagatggttttatcgttccgcacggcgaccatttccactttattcctaaaaaagatttatcagctgccgaattgaaggctgctcaagattactggaatcaaaaaggaagtgtgagctcggctagtggtagtcaatatggcgatagaaataatagagctcaacagaccacaattagtgcggggcaaggtcaggatttggctagtttattggctcaattggatgcaacacccctatctcaacgccatgtagaagcggatggattggtatttgacccaagaacgattacgaagaaaaccgcagcaggtgtcatcgttccacacggcgatcattaccactttattccatacagccagatgtctcctctagaagagaagatttctcgaatgattggtgtaaatggagcaggtgtttcttctggcgcacaagcaagtcgctcccaacatacactaacacaaccaaatcgtccagtaacaccaatcggcactgttacaacgcaaccggtatcgcctacacaaccagtattaccaacacaaccgaagcagtcaacagggaaagtggtttcctataagggacgtcaaattcctgcttacggaaaagggttagatggtaaggcatattttacaagtgatggatacacctttagcaaagactctattacctcagttgatgatcaagggttgatagctagtcatggagatcatttccattatgttggttttggcgaactcgaagattttgaaataaagcaagtagaggaatgggttaatgagaaggcgggcaaacaagtgccaccgaaaacatctgaacaagtaggaaacgatgctaaacccacaacaccaagtcaagggaatgattcaaaacctgtaaaaccaattcaagaagaaaaccgccctgcatttgaatataaacaagtaacggctaaacgtaaattggctggaaaagttgtttatgaaatggaagtaggtggaaaaacttatacgtatggtcgtgacgaactagatttgatgaagatctcttttgctgagttgactttggcagaaaaagataagcagtatatctttgatattgcaccgcttgcagaaggagatcttaagccagccatgttggtcggtatggatcaaattccgatgaagggagcgaatgcgacctatgatactggacaatcctttattattccacacattgatcacatccacgtcctaccttacacatggttgagtaaggaacaaattgcaacgatccgctatatcatgcaacatcctgaaattcgtccatctgcttggactacaagtggacatggtgatggagaagcaacggatcttgttcccccaattctaaatgcaacacctaaagcaaaccgcttaggcttgaaaaattggcaaatcattcacacagcagaagaagttatggatgcgcgtgcaaaagggaaatttgcgacaaatgatggctatatcttctcggcggaagacgtactagatccagcaagttttgtctttagtcaagcgttcagtctaccaagagcgacaggaggttctctacgttcaatttccaagaaagatttatctaaagaagaattggaagctgtacaaactcttcttgataaacgagacgctgaagaattggcgaaaaatgtcacaccaattgagaaacgtgcaggtttgaaaaattggcaaattgttcactcagcagaagaattggcagaagctaaggcagcaggaaaatatacaacaaaagatggctatatttttgacccagcggacctattagatcccaaagtgaaaataggtacggataactatcgcatcccacgtgtgattacagatggttaccgtcggattaacaagagtgatttgaattacttaagcgagctgatcccagcagaggctatggtggctcaacgtgagaaatctaattctagtttaccgtcaacacctgcaccaactgaaacaggagcaagtgcaggcgagacaacaacgccagaacagccacaagttgccaaagaaacagcagaggaaatttataaccgagtggaagcgaagaaagtcgttcctttcgaagcactgacttacaatgctggctatgcaaccgaagtacgcaacgggactctggtgattccgcatcaagatcactatcactatgtatcctttaaatggtttgaccaaggtagtgcaagaagtcctgaagggtatagtttagaagatttcctagcaacggttaaatactacatgactaatccacaagaacgcccagtttcagacgatggctggggagtatttacaccaaatacaccatctgaatcaacagaagaaacagagacggaagaaagtgatgaagaaattatttctgaagaaaccgaggaaattgacgagtttacagaagaattaaaacgaagagcagaagagtttggcatggacttcaaaacctttgaacaaagtctggtcacactctcagaccgttacaaagtttcttttgaagctttcgaatatgatgcagcaagcaaagttgttcgacttgtagataaggatggggtcaaacggaccatctcccttccaagtttagaagaacaagtatagtaaacaaaatacctgtagcactgagctctgcaggtatttttttacagaaaaacgataaagattatctttgactatttgccttttttagcgtaaaatagaagggaaagacaaaaaaggagaacagccttggaacttaacgtatttgcaggacaagaaaaaagcgaactttccatgattgaagtagcccgtgctattttggaagaacgtggacgtgacaacgaaatgtatttcaacgatttggtcaatgaaattcaaaactaccttgaaaaatcaaacagcgagattcgcgcagccctcccaaccttctattctgatttgaatgtggatggaagcttcattccgcttggcgaaaacaaatggggcttacgttcatggtacgcaatcgatgagatcgacgaagaagtgatcactcttgaagaagatgatgaagatgcaccaaaacgcaagaagaaacgcgtcaatgcctttatggacggtgatgatgatgcgattgactatggacatgatgatccggaagatgaggataactatccaggtagtgtatcatcagaatacgatgatgaaaatccagatgacgaaaaagatgaagttgagtcctatgattcagaaatcaacgaaattatcccagatgacgaattggatgaagaggatgttgatttaggtgaagatgacgacgagtattcagatgaagaggtcgtcgacgaataagaattatatccccatagattcttaaaaataatttgacaagactactgaattacgataagatattatcgggcacctcttttgaggtcggagctccctagcgatagggagctatttttgttttttcttcaagttaacaggaagtatccccacaaattgcttcctattagcctgaatcgtagaaaaggagtttgcatgacaaagtatatttttgtaacaggtggcgttgtttcctctatcggcaaagggattgtagcagccagcctaggtcgtttattgaagaatcgaggtctcaaggtaacaatccaaaaatttgatccatacatcaacattgacccgggaacaatgagtccgtatcaacacggtgaagtttttgtgacggatgacggtgcagaaaccgacttggaccttgggcattatgagcgtttcatcgacattaacctgaacaaatattcaaatgttacaacaggtaaaatttatagcgaagtcctccgtaaagagcgtaaaggggaatacttaggggcaacagttcaagttattccacacattacagatgctttgaaagacaaaatcaagcgtgcagctcgtactacagatgcagacgtcatcatcacagaagtgggtggtacagtaggtgatattgaaagcttgccattccttgaagcgcttcgtcagatgaaggcagatgtcggttcagacaatgttatgtatatccatacaacactcttgccttatctcaaagcagcaggcgaaatgaaaactaagccaacacaacattctgtaaaagagttgcgtggtctaggtattcagcccaacatgttggtaattcggacagagcagcctgctggacaaggaattaaaaataaactggcacaattctgtgatgttgctccagaagcagttattgagtccttggatgtcgaacatctttaccaaatcccattaaatatgcaagcacagaacatggatcaaattgtttgcgatcacttgaagctcgacgtacctccagcagatatgacagagtggacagcgatggtaaacaaggttcttaatctccagaaaaaagtaaaaatcgctttagttggtaagtatgtagaattacaagatgcctatatttctgtagttgaagctctaaaacactcaggatatgcaaatgatgctgctatcgaattggactgggtcaatgcaaatgatttgacagcagaaaacgtagctgaacgtctaggacaagcacaaggaattatcgttcctggtggctttggacaacgtggtacagaagggaaaatacaagccattcgttatgctcgtgagaatgacgtgccaatgctaggggtctgcttgggaatgcagctgacctgtgtagaatttgcacgtcacgttctcggtttagaaggtgctaacagctttgaattagacccagaaacaaaatatccaataattgacatcatgcgtgatcaaattggagtggaagatttaggaggaactctccgtttaggtctttatccaagcaagctcaaacgtggctccaaggctgcagctgcttatgataatcaagaagttgtacaacgtcgccatcgtcatcgttatgagtttaataatgacttccgtgaacaatttgaaaaagcaggttttgttttctcaggcgtgtcaccagacaaccgtttggtagaaattgttgaaattccagaaaataaattcttcgttgcctgccaataccatccagaactacaatctcgtcctaatcgccctgaaggtttgtatacagcctttgtttcagcagctatggagaatgaaaaataagtataaccattatagaagaagattggtatcattcaatcttctttatatattttatataaagaaacgaaaaaggtgtcagtattttatagaagaaaatacgaaataccacccccatatggcatcattgtctagatggttttaagcattatatatagtagaatattgcaaaagaatcagctaaatcaatacgttttggcaaaaaaaggtaaaaataaaaaataaaattcaaaaaaagtgttgacaaggctagttcctaatgatatactagttcttgtgttaagcggggatggcggaattggcagacgcgcaggactaaggatcctgtgaccgctttaggtcgtgtgggttcaagtcccactctccgcatagtggactagctaaggctagtccttttgctttgtctagataagtgcagagcacgatatatgctagttcataaattacaagaatgatacgaaacaggcattattatggctttcatgaaaagatatgtgaaagttttctcaaaactagacggtttcaactagcattttcaaaataaaaatggtagaatagaagagtatgaggtgcaacctcaaaaaatattaggaggctatcgaaatgccattagtttcagcagaaaaatttgtccaagcagctcgtgacaacggttatgcagttggtggatttaacacaaacaaccttgagtggactcaagctatcttgcgtgcagcagaagcaaaacaagctccagttcttatccaaacttctatgggtgcagctaagtacatgggtggttacaaagtagctcgtaacttgattgcaaacttgattgaatcaatgaacattacagttccagttgctattcaccttgaccacggtcactacgaagatgcacttgagtgtatcgaagttggttacacttctatcatgtttgacggttcacaccttccagtagaagaaaaccttgcaaaagcaaaagaagttgtagaattggcgcacgctaaaggtatctcagttgaagctgaagttggtactatcggtggtgaagaagatggtatcgtaggtagcggtgaattggctccaatcgaagatgcagtagcaatggttgcaactggtatcgatttcttggcagcaggtatcggtaacatccacggtccatacccagcaaactgggaaggtcttgaccttgaccacttgcgtaaattgactgaagctgtaccaggtttcccaatcgtattgcacggtggttcaggtattccggatgcacaaatccaagaagcaatcaaattgggtgttgctaaagttaacgtaaacactgagtgccaaatcgcatttgcaaacgcaactcgtaagtttgcagcagcttatgaagcaaacgaagcagaatacgataagaaaaaactctttgacccacgtaaattcttggcagacggcgtgaaagctatccaagcatctgttgaagagcgtatcgacgtattcggttcagcgaacaaagcttaatgtaactgcgaagaaatcttagatttcaagcaaacaaagcataagtttcttagattaaaccaaaaaggattttctttcgagaatcctttttattataatagttgattaagtttgatctagttctttgctatgaagaaatctacgatagaagtgagcagagaacagttaaaatataaactgctccaaagttttcatgactgtaataacttagagaacgaagaattatggatggggcgcaaactgtagtattaaaatatttacctatgagtatagacactttaaaaaataaaaatgaaaataattcttgccaagtccaatcttttctgttagaataatgtggtatgtggtgctagcacatccgatatatttgatcaaatgaggaggaagatacaatggctaaagtatgttatttcactggtcgtaagactgtatcaggtaacaaccgttcacacgctatgaaccaaactaaacgtgcagttaaaccaaaccttcaaaaggtaactgttttgattgatggtaaacctaaaaaagtttgggcttcagcgcgtgcactaaaatcaggcaaagttgaacgtgtataataacaaagtcgttagaaaaatctagcgacttttgtttttggaaaaaatagcctagatataaagtcggtgaggagcaaattcgaccactacataatgaataggaaagaatatcagctatatagctcttcacattgctgttgaaaagttaacaaagaaggaatgttgtcaaaaataaactgtgtattgatgtggaagatttttccaagttcgaacatttaaacttggattgacattaggagttgtacgagagagcatccgtacgggttctacaagaagggaatcacgaactggaagaatagagagtgtttaaaaaaatccaaaaaatctcaaaaaaccggttgacaatgtatataagtcatgatagaataaatgagttgtctcttgagggactggttaacagagaaacgaaaaaagtttcaaaaaagtgttgacaaagttcacaagaaatgataaactaagatagttgtcgcgagagcgcgataacgacaagacctttgaaaattaaagaagacgaaccaaacgtgcagggtgatttatctaaagataaatcgtcaatgacaaaacaaaacaataaaacggaaagctagcaatagcttgagtttgaatcaaaactttttatgagagtttgatcctggctcaggacgaacgctggcggcgtgcctaatacatgcaagtagaacgctgaagtctggtgcttgcactagacggatgagttgcgaacgggtgagtaacgcgtaggtaacctgcctcatagcgggggataactattggaaacgatagctaataccgcataacagtatttaccgcatggtagatatttgaaaggagcaattgcttcactatgagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaactgtgagaagagtggaaagtttctcacttgacggtatcttaccagaaagggacggctaactacgtgccagcagccgcggtaatacgtaggtcccgagcgttgtccggatttattgggcgtaaagcgagcgcaggcggtttgataagtctgaagtaaaaggctgtggcttaaccatagtacgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgaccgccctagagatagggtttctcttcggagcatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaaatggaaacctgtacgtcagtcttctttaattttgagaggtcttgtggggccttagctcagctgggagagcgcctgctttgcacgcaggaggtcagcggttcgatcccgctaggctccattaacaacggaagttgttaagattttgtccattgaaaattgaatatctatcaaacattcctaaacgtatgtaaaagtacgtatagaaatagtaacaagaaaataaaccgaaaacgctgtgaatatttaatgagttttctaatttttgaaaaaattaggttaaaacaagttacgaagacgttaaggaaaacgtatgattttaggaaatcatcgcagtagtctaaggactacaagaggatttgtctaaatcactagttttctagtctgagtacgattataaggttaagttaataagggcgcacggtggatgccttggcactagaagccgatgaaggacgtgactaacgacgaaatgccttggggagctgtaagtaagcaatgatccagggatgtccgaatgggggaacccggcaggtaatgcctgtcactcactactgttaaggtagtgaagaggaagacgcagtgaactgaaacatctaagtagctgcaggaagagaaagcaaaagcgattgccttagtagcggcgagcgaaacggcaggagggcaaaccgaggagtttactcctcggggttgtaggactgcaatgtggacttaaagagtatagaagaactacctgggaaggtaggccaaagagagtaatagcctcgtatttaaaatattttttatacctagcagtatcctgagtacggcgagacacgcgaaatctcgtcggaatccgggaggaccatctcccaaccctaaatactctctagtgaccgatagtgaaccagtaccgtgagggaaaggtgaaaagtaccccggaaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcggattagtattatgtcgtagacccgaaaccatgtgacctacccatgagcaggttgaaggtgcggtaagacgcactggaggaccgaaccagggcacgttgaaaagtgcttggatgacttgtgggtagcggagaaattccaaacgaacttggagatagctggttctctccgaaatagctttagggctagcgtcgacatttgagaatcttggaggtagagcactgtttggatgagggggccatctcggtttactgatttcagataaactccgaatgccaatgatttatggtcggcagtcagactgcgagtgctaagatccgtagtcgaaagggaaacagcccagaccaccagctaaggtcccaaaataattgttaagtggaaaaggatgtggggttgcacagacaactaggatgttagcttagaagcagctattcattcaaagagtgcgtaatagctcactagtcgagtgaccctgcgccgaaaatgtaccggggctaaaacaatttaccgaagctgtggataacactttagtgttatggtaggagagcgttctatgtgtgaagaaggtataccgtgaggagtgctggaacgcatagaagtgagaatgccggtatgagtagcgaaagatgggtgagaatcccatccaccgtaagactaaggtttccaggggaaggctcgtccgccctgggttagtcgggacctaaggagagaccgaagggtgtatccgatggacaacaggttgatattcctgtactagagtatgaagtgatggagggacgcagtaggctaactaaagcgggcgattggaagtgcccgtctaagcagtgaggtgtgatatgagtcaaatgcttgtatctgtaacattgagctgtgatggggagcgaagttaagtagcgaagttagtgacgtcacactgccgagaaaagcttctagcgatgtatcatactctacccgtaccgcaaaccgacacaggtagtcgaggcgagtagcctcaggtgagcgagagaactctcgttaaggaactcggcaaaatgaccccgtaacttcgggagaaggggtgctggcttaaagtcagccgcagtgaataggcccaagcaactgtttatcaaaaacacagctctctgctaaatcgtaagatgatgtatagggggtgacgcctgcccggtgctggaaggttaagaggagggtttagcgcaagcgaagatctgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctacgaagtcgggacgccagtttcgactgaggcgctgttgggatactacccttgtgttatggctactctaacccggataggttatccctatcggagacagtgtctgacgggcagtttgactggggcggtcgcctcctaaaaggtaacggaggcgcccaaaggttccctcagaatggttggaaatcattcgcagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggacgggataaacgctgaaagcatctaagtgtgaaacccacctcaagatgagatttcccataactttatgttagtaagagccctgagagatgatcaggtagataggttggaagtggaagtgtggcgacacatgtagcggaccaatactaatcgctcgaggacttatccaaagaaataaactagagtcaatattgacaagcgatcggtttcttgttagaatatagatattcaattttgagttgacaagactcagtagttaagtgacgatagcctaggagatacacctgtacccatgccgaacacagcagttaagccctagaacgcctgaagtagttgggggttgccccctgttagatacggtagtcgcttagcatattccgccatagctcagttggtagagcgcatgactgttaatcatgatgtcacaggttcgagccctgttggcggagtaaagagaaatctttagtatatggtccgttggtcaaggggttaagacaccgccttttcacggcggtaacacgggttcgaatcccgtacggactatatttggagactgcttaagtctcttttttttgttttttgaggtgtatgggctttaatatggctcctttttcttttcttgttactttgtctattcattgtttgttgatataatagagatatgaaaagactatgtgatgaattatcggttttgccagggattggtccaaaatcggctgaaaaattcttaaaaattagcattcagaatattaatgatttgctgacttactatccatttagatatgaagattttgagagtaagtctatttatgatttgcaggatggggagaaggcagtggtagttggggaggtggtatctccagctaatgtacagtattatggttacaaaagaaatagactccgtttttcaatgaaacagggtgaggttgtcttagcagtttcgttttttaatcagccttatttagcagataagattgttttggggcaggatattgcagtttggggaaagtgggataaggctaaggcaagtttgacaggaatgaaaattttggctcaagtatcagatgagctccaacctgtctatcatgtggcgcaagggatttcgcaagtaaatttggttaaggctattaaaacagctattgatcagggatatttgcatttattagaggagaacttgccatcagttttacgagagcgctatcggttaatgaatcgccgagaggcggtttttgcgatgcattttcctacaaatttagaagagtatagacaagctttgcgacgtatgaagtttgaggaattattttattttcaattacagttgcaaatgctgaaagccaacaatcgtgatattttgaatggtttgaagattgcctatgatgctgatagattggctatgcaaataagacaattgccgtttgtcttaacagatgctcagtctggggctttggctgaaatactatcagatatgaagtcctatgggcacatgaatcgtttgttacaaggggatgttggttcagggaagacagtagttgctggattggctatgtttgctgctgtgactgcggggatgcaggctgcaattatggtgccgacagaaattttggctgagcaacactttgagagtttgcgccagctttttccagaactttctattgctcttttgacaggtggaatgaaagctgcggagcgtcgtactgctttagaggcgatttctagtggtcaggtagacatcattgtaggaactcatgctcttatacaggaaagtgtgacgtaccataagcttggtttggttgtgacggatgagcaacatcgttttggtgttaaacagcgccgtctgtttcgtgagaagggtgataatccggatgtgcttatgatgactgctacacctattcctcggacgttagccattacagcttttggagatatggatgtatcaattattaatcagttacctgctggtcgaaagccaattatcactcgctgggtcaaacatcaacagctgcccacggtcttagattggttggagcgggagttagaagtgggtgctcaggtttattttatctctccgctgattgaagaatctgaggctctagatttaaagaatgctgtagatctacaatctgatttacaggcgcattttggagagcaagttacagtggatttgttacacggtaagatgaagaatgacgagaaagatgccatcatgcaggcttttaaggagcgaaaaacgaatattttggtttctaccactgttattgaagtcggagtcaatgtgcccaatgcaacggtgatggttattatggatgctgatcgttttggtttaagccaattacatcagttgagagggcgtgtaggacgtggtcataagcagtcttatgcagtgttagttgctaatcctaaaacagagtctggtaaggaacgcatgaaaattatgacagagacgacagatggttttattttggctgaagctgacttaaaaatgcgtgggtctggagaaatatttggaactcgtcaatcaggtttgccagaatttcaagttgcaaatattatcgaggactatccaattttagaggaagcaaggcgagttgctagtcagattgttagcgtggaaaattggcaggaggaccctaattggtcgattttgcttgctaatttgaaagatcgagaggaattggactagtcatataaaaaaggccaacacacatgtgttggtcttttgacatattgtatagttcgtcagcgattaaccttggatgtaatctgccaagctttgctcttccaagcctgcattgagagcgataaggagtttgagtcgggctttttgagcattcaattctttaacaaatagaatgccgtctttctccagttggatgccacctccttggtaggcatagacaggctcagcaattccgttaaaacagcgagataccagaataatgggtatcttttgatcaaggagtttcttaatggctggaaggatggtaggcggaagatttccggcgccgagtgcttcaataactaaaccggaaattgagcttgcagtgagtgaatcaaggagaatggagtccatatctgcataagcttttatgattgggaccgttcctgtgactgttgataagtcaaatcgaacacgtggttcagcagttttaaaatagagaatctctcgtttggtgactaatcccagtggtccatgggttggtgtttgaaaggttgagacattggtggtatacgtttttgtaacatatttagcagcatgaatttcatcgttcatgaccactagaacacctttatctgcggatttatcatcagtagccacacgtagggctgttcggtagttataaatcccgtcgctacccagttcatttgaggaacgcatggctccggtcaatacaattggtttttctggaatagccattgtatcaaggaaataggcagtctcttctaaagtatctgtgccatgtgtaatgacaaaaccatcgaagttcatttgttcttctttgattttttggtatagagtcatcatgtgttctaagcgaatgtgtggacttggaacattgagaaaatccaaggatgtcacttgagtttcttctagtgggctatcaatttgggtcattggattggttttactcgctgcaacttcaccctgatgattggtttgcatagaaatggttccacctgtatgcagtactagaatttttttcataaattttcagtttctttcaaagtgtgatatactaattgtaacataattcttagaaagtaggtgagttggttgacgataaaggctgtatttttcgatattgatggtaccttattgaccgacaatcgtatggttagtagttcaactattctcgccattaatgctttgaaagagaaggggattttagttggtctagctacaggacgtgatcctcgttttgttttgcagtatatggctagtttagggctagatttggccattgcttataatggtcaatatattttttcaagagaagaagttatttatagtcagagtttagagccaaagcaaattgaacaaattatggagtatgcgcaaactcaccataaggatttatcttttggaactgctaaaggcatatttggtagtaagattatgagtgctggaacaggaaattttgcatatcgtgtgacgcgtatgattccggagtcctgggctggaatcataaattttattttcaatcgtttggtacgttggattagtcctcaacaggaaacgaatttgaaaggttttctctttcaaccaatctatcagctgatgttgctgacgacggaaagggagacacaatcattggaggtgctctttccgaacttgtcttttacgcgttcgagtccctatgcgactgatattatcagtaagggaaattcaaaattatcgggtattgtaaaggttgcagatcgatatggttttgagttagatgaagttatggtattcggggattctaataatgattttgaaatgttgaatgaaattcagcactcggtagcgatgggaaatgggacgaaaaaggttaaacacgcagcttcctttgttacggatacaaataatcgtgatgggatttataaggcattaattcattttggtgtgattgagggataagatgtttcagagcaaggacgataattttaatagggtaaaggattttcattttttaatggatggtgaaacacaagaacttcccagtgtgtatgatggacagacggctttgtatcgcgctggttttaaattggaggagttggtagaatttctacatgcagcttcagaatctgaagttgagtttcatgattttattcaacaacttcatcaggatttagatactgctgctgctaaggtatctggcaagagaggtttcggggtttcgatgcaggatcaggtagatgctttgctggatattctttattttacatatggttcgtttgttttgatgggggttgatccagaaccaatttttcagatagtccatactgcaaatatggggaaaacatttccagatgggaaggcccattttgatccaattacccataaaattttaaaacctgatgattgggaagaacggtttgctccggaggaaaagattcaggaagagctgaaaagacagatgaaaagacttgattcgtaaatcaagtcttttggtttataaacttttttctccatcgcgaacaatgagtaaatcgatagttgcgtggcgcatgatatattcggatgaggatccgattaggagacgttcaaaggcgtttagaccagttgctccaagtaacataagatccgcaccggtttcctttggaatatcgatagccagtagggttttagggttaccgaattcaatgcgaatctgtacatcggtcagaccggcgttgagagcttcttgtttgtattcttcgaggaggagctccgcctctctttctaaagattcatagacagaggcgtcaaatgcaacaacattgtggagagcacgggtgtcaatcacatgggcgataatcagacgtgcttggttgcgtagtgcaacatgaatggctttatgaagagctaattctgctcctttagagccgtctacagcgacgagtattgttttgtaagattgtgtcataatagtcactcctttcagaagagctttgtcccgaaataggtagagtagttccttacatttttattataagccttttgagagaaaatgtaaaggattcttgtacttttttagcttttacagtacaatagaaaagatagaaagttgaggtgacgacatgaagcaatttaacaagtcaacaaaattggatgatgtagcatatgatattcgtgggcctgttttggaagaggccatgcgcatgcgtgccaatggagagcagattttacgtttgaatacggggaatcctgcagaatttggttttactgctccagatgaagttattcgtgacttgattcataacgcccgtaaatcagagggatattcgaacagtaagggaattttttctgcacgtaaggctatcatgcagtattgtcagctaaagaaatttccaaatgttgacattgaagatatttatcttggaaacggcgtgagtgagctgattgttatgtctatgcaaggtttgctagataatggtgatgaggtgttggtgccaatgccagactatcctctctggactgctgcagttagtttggctggtggtaaagctgttcactatgtttgtgatgaagtagctgaatggtatccagatttggcagatatggagtccaaggtgacttctcgaaccaaggcaattgtccttatcaatccaaataatccaactggtgctctctatccgaaagaaattttaaaaggaatcattgatattgctcgtagacatgaattgatcattttctctgatgagatttatgatcgtatggtctttgatggagctgttcatatccctattgcgacactggctccagatttatttgttgtgacgatgaatggactgtctaaatcacatcgtatttgtggtttccgagtaggttggatggtcttatctggtccgaaaaagcatgtaaaaggttacattgaaggcttgaatatgttgtccaatatgcgtttgtgttcaaacgttttggctcaacaggttgttcaaacttctttgggaggttaccaatcggttgatgagctcttgatgcctggcggacgcttatatgaacaaagggagttcattaccaaggcgattaatgatattccgggactttctgctgtaaaacctaaggctggtctgtatgtattcccaaaaattgatcgtgagatgtacagagttgaggatgatgaacaatttgtattggatttcctcaagcaagaaaaagtacttttggtccatggtcgaggttttaactggaaggatccagatcatttccgtattgtgtatttaccacgtgttgatgagttggcagaaattcaagaaaaaatgtcacgattcttgcggcaatatcgtagataatgggagtgggaaagaactcaaccattcataagaagagttcgtcaacaagtctttatttctagttgttgagctgaaacagtctattcccagactgtttcgctcccacctccgcacagctcaaactgtctgggagacagtttgaggttggagatgaagcgaactctgttcgcatcagtcgtataggtcagattttgaatgtaaaacacgaacgaatctgccaatcaaccactgcgctgagatgttgacactaactttgagaagcggtgctgggctttttgcccagcctatttctttttgcttggatgaaattgtttgtgtttttctaacaacggtaaatattctgataattgttgaaattttatgtattttttgctatactgaaagcaattacagagtaaagaggaaaatatgacaacattattagagaagacacggaatattacttctattttgaagcgttccgaagagcaattggcagaagaattgccttacaatgctattgctgaacatctatcagctattattgattgcaattcttgtattattaatagcgaaggtgaagttttgggataccacatgagttacgagacaaacaatgatcgtgtggaagaatttttccaaaacaaacaattcccagaaggatatgtaaaagcagttgcgcaggtttacgatacgcaggttaatttgcctgtcgagagcgagttgactgccatccctgtcgaatcacgctcgacttatccaaacgggctgacaacgatagcgcctatccacgtaacggggattcgttttggttcgcttattatttggcggaatgatgagcagtttcacgatgatgatttgattttggttgagattgcggcaacagtagttggtattcagttacttaatttccaacgggaagaagacgagaagaatatccgtcgtcgtgcggcagttaatatggcggtaaatacgctatcttactcagaaatgaaggcagttgcagctattttgggtgaattggatggcaatgaggggcaattgactgcttctgtgattgcagatcgtatcggtattacacgatcggtgattgtgaatgcactgcgtaagttggagagtgcagggattattgaaagtcgttctttgggaatgaaggggacttatttgaaagttctcatcccagctatttttgatgaaattaagaaacgtgactactaaaatgacaaaagcattgattatatagtagattttgtggcagatgaaggaaagctgactgctggaaaatcagctcaggctatttctaaacgaattgctcaggttacgcaagaagcttttgaaaatggagactatattttctttgcgattgatggtcatgaggagggggatgaatttcatcctgaagctcagcttttcccaagtcataatatcattgggacgcaagggcgtgacttgtatggtcctttagcagatttttatcaaaaacataaagggcatgcgcgtgttcgttggatggataaacgtcattattctactttttctgggacggatttggatgttcgactaagagaacgtggtgtagatacggttgtcttgacgggtgttttgtctgatatttgtgttcttcatacagctattgatgcttataataaggggtatcgtattgaggtggtctcatcagccattgctgcattgacggaggagaatcatcagtttgctcttaaccatttgcgtcatgtactcggtgcgacaattattgattaatagtatagtgaccagtctgtggactggtttttacaggaatctgtatcattaacactcttcgaaaatcaaactcagaccttgttgacttaacttgtaaaagaagcggtgtgattgaccatgataaatttatcaaaatgctttacataggtgattacttggtgtataatatagtctgtgtgtaatggacgcacaaaaatacagtttatccgctgggtttaaaagcacctaagattgacaaagataggagaataaaatgaatccattgatccaaagtttgacagaaggtcaacttcgtactgacatcccttcattccgtcctggtgacactgtgcgtgttcacgctaaggttgtcgaaggtaaccgcgaacgtatccagattttcgagggtgttgttatctctcgtaaaggtcaaggcatctcagaaatgtacactgtacgtaaaatctctggtggtgtaggtgttgaacgtacattcccaatccacactccacgtgttgataagattgaagtagtacgttacggtaaagtacgtcgtgctaaattgtactacctacgtgcattgcaaggtaaagcagcacgtatcaaagaaatccgtcgttaagatagtcctacagactattttggtcggagaatgggaggcagcgaaagctgtctctttttttaaaaaaaatctgttgaaaaagtaccaaattgtgaaagcataaaatggaaataatatgttatactatatattattgtagcgagtatagaggaggttgcggatgagcgaacagtttattccatctgttttatcagatttacggcaagatattgttcagatgccagaagttatcaaggaatgtagtggaattcgtatttatggtcgtcgcattcgttcagtcttatttacaacggatgtgtctattattgctaatcacaatgcagatgctattttggctgtttatccatttacgcccagtccagctattatcaaaagtattatgttggttgcgtcagttccagtcttggctggtgttggtggaggcttgacgacaggtatgcgttcagctaatatgagtctcttgtctgagtcggagggagcatacgctgttgtggtaaatggaccaacggatgtaaaaacaattgaggcaatcaataaagtagtagatattcctatcatttataccgttgtttctgaaaagtctgatttaacctcacggattaaagctggagtagatattttaaatgtttcttgcggtatggaaacgccaagggttgtgaagaagattcgagaagctttccctgactttccaattattgcgactggtggtccgactgaggactctattcgtcgggttatcgaagctggagccaatgctgtctcctatacagcaccaagtaatggggagctttttaaagggaaaatggaaaaataccgcaaacatgcaaaggattagctcataaaaagataggctaagcaaacagtaagttttattgctagatgaaacttgctgttttttatcgttttacggtgtgagattaggaatacttcgcaatttaaagaatggatttttaggaggaaataggtaacatattaggtcatttctacctttgtctgaggctggaaatatggtataatgagaagatagatttccattaggaggaaagtaagaatgaagatttctgaagctgaagtccgtcacgttgccaagctgtctaagctggaattttcggaccaggaaacagcggaatttgcgacaagtttgagcaagattgtcgatatggttgaattgctcaatgaagtagatacgacaggtgttgcggtaacgaccactatggctgaccgtaagaatgtcttgcgagcagatattgcccaaaaaggtgagagccgtgaggagctctttaaaaatgtgcctgaatcacaagataactttatcaaggtaccagctattctagacgggggaggagatgcctaatgacttttaacaataaaaccattgatgaattgcatgacctccttgtcaaaaaggagatttctgcggttgagttgaccaaggcaactttggaagacatcaaaagccgtgagggagcagtggatgctttcttgactatcacagaagatgcggccttggcgcaggctgctgcccttgatgaaaaagggattgatgcggacaatgttatggcagggattcctttggcagtcaaggacaatatctctactaaggggattttgaccacggcagcttcaaaaatgctttataactacgagccgattttcgatgcgacatcagttgctcaggcctacgcaaaggatatgattattgtcggtaagacaaacatggatgagtttgccatgggtggttctaatgagaactctgccttcaaaccgactaaaaatgcttgggaccagacaaaagttcctggtggttcttcaggtggctcagctgctgctgttgcatctggtcaggtccgtttgtcactcggttctgacacaggtggttccattcgtcaaccagcagcctttaatggtatcgtcggtatgaaaccgacctacggaacggtgtcacgttttggtctgattgcctttggttcatctcttgaccagattggtccattctcacagacagttaaggaaaatgcccagttgctcaatgtcatctctggtcatgatgtcaaggatgcaacatcaacgatcaatgaaattgcagacttcactagcaagattggtcaggacatcaagggcatgaaaatcgctcttccaaaagaatacatgggcgaagggattgatccgcaggtcaaggaaactattctcaaggcggctaagcacttggaaagcttgggagcaatcattgaagaagttagtctgccacattctaagtatggggttgctgtttactatattatcgcatcatcagaggcgtcttctaacttgcagcgttttgacggtatccgctatggtttccgtgcagaagatgcgaccaacttggatgagatttatgtgaaaacccgtagccaaggttttggtgaggaagtcaaacgtcgtattatgttaggtacatttagcttgtcatctggttactacgatgcctacttcaagaaggctggtcaggtgcggaccttgattatccaagattttgaaaaggtctttgcggactatgacttgattttggggccaactgctccgacggttgcctttggtttggacacgctcaaccatgaccctgtggccatgtacttggcggacttgttaacaattcctgtaaacttggcaggtcttcctggtctttctattcctgctggttttgtagaaggcttgccagttggtttgcagttgattggtccaaaatactcagaagagaccatttaccaagtagctgctgcctttgaagcgacgacagactaccacaagcaacaaccagtgatttttggaggtgctaactaatgaactttgaaacgattattggtctagaagtccatgtggagttgaataccaactcgaaaattttctcaccttcatctgcgcattttggtgaggatccaaatgccaataccaacgtgattgactggtctttccctggcgtccttcctgttcttaataagggtgttgtggatgctggtattaaggctgccttggctttgaacatggacattcacaaggacatgcactttgaccgcaagaactatttctatcctgataaccctaaagcctatcagatttctcagtttgacgagccgattggctacaatggctggattgagattgagctagaagatggttcaaccaagaaaatccgtatcgagcgtgcgcacttggaagaggatgcaggtaagaatacccatgggacagacggctattcttatgtggacctcaaccgtcagggcgtgccattgattgagattgtatcagaagcggatatgcgttcgcctgaggaggcctatgcctacttgacagcccttaaagaaatcattcagtacactggtatttcagatgtgaagatggaagagggttctatgcgcgtggatgccaacatctctcttcgtccttatggtcaggagaaattcggtaccaagactgagttgaaaaacctcaactccttcaactatgtgcgcaagggcttgcagcatgaagtagaacgtcaggcgaaaatcttgcgttcaggtggtcaaatccagcaggaaactcgtcgttacgatgaatctactggtgaaaccattctcatgcgtgtcaaggagggttcagctgactaccgttacttccctgagccagacctgccactctatgagattgatgatagctggattgaggaagttcgtgcagaattgccagtctttccaaaggctcgccgtgctcactatgtagaaaacttgggcttgaccgcctatgatgcaggtcaattgacgtctaccaaggccttgtctgacttctttgaagcagcggtggcagcaggtggcgatgccaaacaagtttctaactggttgcagggtgaagtggctcagttcctcaatgctgaaggtaagactattgagcaaatcgccttaacaccagaaaacttggttgagatgattgccttgattgcggatggaaccatttcatctaaaatcgccaagaaagtctttgttcacttggccaaagaaggtggctctgctaaggcttatgttgagaaggctggtttggtgcagatttcagacccagcagtcctcattccgattatccaccaagtctttgcggataacgaagcggctgtagctgacttcaagtctggcaaacgcaatgcagacaaggcttttacaggtttcttgatgaaagcaaccaagggacaagccaatccacaagttgcacaacaactcttggctcaggaattggctaagttgttggattagttttaaaactatagaaactatagaatacaaaaatcactcaaaaagagtggtttttctaccatttgtcaagttcatcaaggtatttgacgaaaaatattttgtgtctcgtcatccaaataaggaaattgttttattttggactaaagttacgtgtaaaaagtgcatacaaaaccaacaccttatgttgaaattttttgataaggtgttacaatgatatggcataaacagttttaccgattttgagttgaagcgtaatcgtaaaatttgttatgcataatgaggtaatacattgtccgaatgagacgatgtatggaggcaatcgtgtgcagcttcgttgaagtcgtttgcgattgtctttttcgtttcttataaaagtctgcgatatggcaaggattggtatgattggctgaagcgatattgtggatacacttgaacagaatctttctagcgtagggattaccacgcttggtaatgtgttccttagcgaggaagttaccagattcatagtgtctcaggtcaataccgataaaggcattgatttgattggcagactgaaaacggcgaatatctcccagttcaccaataatacttgttgcagtagtctcagctattccaggaatagagagcagaatgtcatattcaggtaatggctgagctagttccaccatttcgtctaagactgcctgtctctgttcagaaagtctaagcaattcttttgtatagtaacggacctcttccagtattggagaggttttcttgacggcacaataagattgattagctagtgctataagcttctcggctaagtaagccacacgcttgtcagaaatccgttttgaagtggacagacggatgctctttgagagttcatcattgcttaactcaagtacgcagtccttacaaggaaaagctataactaagttccagtattgttcgccagatggtgtcgataagatattttccaattcagggaaagtgacctgtaagaccttgtgcaggcggtttttagctcgaacaatatcctcggtcagattctgatagaaacggctgagatcccgcaagttttggtagacttcttcttggacataagtgggtttacgattcagcacaaattgagattgagccagtttttcagcgtcaatttgatctgttttccgcacacgcaagctatccagttgcttcttagcttctaagggattaagccgtgtataagcatagccattatcatctagaaaagtttggagacggcgagaatagacacctgttgcttcaaagatgatttctggcttatggacggttctcaaatcgccaagtagccgagcaaagccgatggcgtcattggatatggtatagccatgaactttctcaccattgactagaatggccacttctgaacttgccttactcacatcaatcccaaaaactactcgcatgatattacctctttgtcttgaatgattccttgttttagcgatgtcattttcaatactcgacgtctggcgtcccacatactttgataacattctttctaaaacaggtgtcttgccagtttttgttgcgacgtctagcgtcaaaagcaccctcgacttaacaagacacctctactttatcataaagaaaaagtagtgagtactttctcccgtcggagatttcctcactactaatcttagtatgtttttgttgactaaaataataattattattatcatcatgatataaaggtatgagggggaataaatagatatgtcaaaagacttcgatgattttttacgagaacatgaggagaatgtcaataagttaaagaaacgtgataaggaaactgagtcggataaggaaagagcaagagatgaattttctagagattattccagggtaatctattctaattcctttagacggcaacaagggaaaatgcaactgtttgccgttaatggtagagcttttcacaggaacaggctgacacatagttttgaagtggcacagattgcaagggggattgttgattatttgaaaaaaaatacatctaataatattgatatagatttcaattcgatgtctgtcgttgttgaaactggtgcacttgtacacgacattggcaatcccccatttggtcatcatggagaaagaattttaaatgatttggcaaaggatattggttttgaaggaaatgcccaagggttacgggtattaaaaaatattgaaaaaaagtctccagatcataaaggcttaaacttaacatatagaaccctagcttcaattctaaaatattatgttccatatagaaaatcacgaaagactgagaagttcatatacaaagaagattatgaggaatttaaaaagagatttaaagaaatggatgtgtttgtgagaacaattgatgttcaaattgttgatttggcagatgaaattgcttattgtgcacatgacttggaagatgcattggcgagtaactacttcaccattgatcaatttgtatttttgttggaacagaaattgggagaagatcaaacattagaggattttaaggaatggattgaagaggcaaaaaataaggcaaaaagaagtaaatccaatgatgattatgatttttattttagacgagaattgctttctattattgtgaataaattcattgaggatatagacattgtagaacttaatgaaaaagacaagaaaaaattaggaactgatcaggatcaagaactagggctcggtcattataaaaaacttgctggtgcattgaagaaaacaattttcgaaggcgtaacaaattctgacgatattattttatatgaaaatgttgggacgaaagtgttgactagattatttgctttattcatgaatgaagaatataatcgggagagttttttgatgccgatcgaatatcgatttgaaaaagacgatacccaaagtgacaagaaaagaaaagtactagattatatttctggcatgatggacacttacgcaattgagatgtatataaaacattttggtacagatccgttcttagagaaatatgatgcagctatattcaagaaaggaactggtaaaaagctaatagaatgtttagcacaaaatttcttacataaatagccatatgtttaagaaaaccgagagttcgtgttgaattctcgggttttcttatgcacttttagtaagaactctcgcgtattaccagctgggtacccaacttaatcttacgggggtggtggggcgttggacttgttatgatacggtccagtagctgcatagcttcctggcccatttcctcagtgaagacgctgatggaagacagggctggatagacttggcgcgtgatggctgtatcgttaaaggtgatgagttggattctatctggcactgcgatttgacgttcttgtaaagcacgcagggcaccgacagccagagtatcgtttgccatgaaaaaggcagggggtagcttgtcgcctaggtcctcaatagcctggctcatcagctcatatcccgactgggtggagaattttccttgatagatgtagtcttcttggagcatgcccaaggtgtctaggtagtcacgaaaggcagtcaggcgggggtctgttggcagttggtgtccatctgtggtttcttcctgtccgactaggagtccaatatcagtcagaccttgtgaatggaagtggtcgataactgtctgaacagagtgttcaaagtcagttgtgacgcaggagaatccctcggtcagcgtatcagagtccacaaaaatgattttagaagacaggctagatagctctgctatttgtccagaagaaaatttgccaactgcgatgatgccgtccacttcttggaggaggggattggtcaggtcgttgaaggagcggacgatttggtagccgagtaagctggcggtatgctcaatactggcccgaatggagtagtagtagaggtcggccagctcttcgctctcggtgtaccactgaacaataccgatggtgcctttttgttgaggtgcttgttttttgatgtgcttggtgtagcccaattcctgtgccaagttgaaaatgcggtcgcgggtttcttggctgacggatagggtcaggtctcccttgagaacgcgggaaacggtggcagaggaaaggtgggcttgttttgctatgtctttgattgtaaccatgttcttctcctgtttatttgtctctagtatagcataaaaaaacaaaattagtaaaaatttagtaaaaatattgacttttaaattgttgagttgtacaataaaagaaaacgattacaaaatctaggaggttcttatgaacacagaacaactcaagcaggcctttctcgatgtgtttggtcaagaggcagatgcgactttcttctcaccaggtcggattaatttgattggtgagcacacggactacaatggtggtcatgtctttccagcggctattaccttggggacctacggggctgctcgcaaacgtgatgaccaagttttgcgtttctattccgcaaactttgaagaacttggaattatcgaagtggatttgaacaatctggtctttgataaggcggataactggaccaactatgccaagggggttctcaaattcttgaaagaagcagggcatgtcattgatacagggatggaagtctttgtttacggtaacattccaaacggttcaggcttgtcatcatcagcttccttggaactcttgattggcattatcgcagaagagttgtatggacttgaattgactcgacttgatttggtgaaaattgggaaacaaacggaaaatcactttattggtgtcaattctgggatcatggaccagtttgcgatcggtatgggagcagataatcgggcgatttatctagataccaatagcttggagtatgaattggtaccgctagatttgggtgaccatgtgattgtgatcatgaacaccaacaaacgccgtgaattggcagattctaagtacaatgaacgtcgcgcagaatgtgaaaaagcagtggaagaattgaatgctgtcctgaacattcaaactctgggagaattggatgaatggacctttgatcaatatagttatttgattaaggatgaaaatcgtatcaagcgtgcccgccatgctgttttggaaaatcaacggaccttgcaggctcgtaaggccttggaagaaggagatttggctacctttggtcgtctggtcaatgcttcccatgtttccttggaacatgattatgaagtgacaggtttggaattggataccttggctcacacagcttgggagcaagaaggagttcttggtgctcggatgacaggagctggcttcggtggctgtggtattgccattgtccacaaggataaggtggaagccttcaaagaaaatgtcggcaagacctatacagaggttgtgggctatgcaccaagcttctatgtagcggagattgctggaggctctcgcgttttatctcgaaaatagattggagaaatgatgacaggattggtggatcgttttgttgagcaggttattgccaacagtgattttgaggaaatggatgctatctacctgcgaaatcgggtcttggctttggtgggagaccaggttctgactgttcaaacagatttagaggacttgattgaattaaaagatgaactattggcacatggagttcgaactggttttgtgggtgaattgctggaagagcaggacatggttgggtcttgtttgatggatttgatgacaccgagtccgagtcaggtcaatcgtgatttttggcagacctatcaggatagtccagagcaagcgattagtgacttttatgaattgagcaaacgtaatgactatatcaagatggctgcgattgcgaaaaatatctattatccagtttcgacagagtatggggatttggaaatcacgatcaatctgtccaaacctgagaaggatcccaagtctattgcagctgctacgaaagctgaagcaagcaattatcccaaatgcctactctgcatggaaaatgagggctatcagggacggattaatcatcctgcacgcgccaaccaccgcattattcgcttggagcttggacaggaaaagtggggcttccagtattcgccctatgcttactacaatgaacatgctattttcctaaatcaggaacatgtgccgatggttattagtccgcgaacttttgagcagctcttggacttgttggatttgttgccaggttattttgtcggttccaactctgacctccctatctcgggtggctctatcttgacccacaatcactatcagggtgggcggcacagttttgccatggatcaggcgccgatagaacaccagctggtcttcgaaggctttgagtcagtttcggctggcattgtcaaatggcccatgtcggtgattcgcttgagttcagcagacaaaccgtcgcttcttggtttagcggctaagattttggaaaaatggcggagctactcagatgatagcgttcagattaaggctgagacagatggaacaccccatcatacgattaccccaattgctcggaaacgaggcgatttgtacgagctggatttggttctccgcgataatcaaacttcagaagagtttccagatggcatctatcatccacatccagatgtgcaacatatcaagaaagaaaatatcggcttgattgaggtaatgggcttggcgattttacccccacgcttgaaggcagaattggctgaagtagaaaaattcttactgggtcaagatagtcaggtggctgactatcatcagccttgggcggaaagcctgaaaacagctcacccagatgtgacggaagaaactgtcgaacaagtagttcgtgagtcagtgggacaaatctttgcgcgtgtattggaagatgcaggggtctacaaacgtactccagaaggacaggcagcctttctacgattcgtagaatttgtaggtttagcaacataaatgtaagaaagagtgggacggtgtcctgctctttttggtataatggaagtattcacagtgtgagaaggagatatgatggcggaaaagagattggggacactgattacagtaatagcaggtatagcctggggcttgtctggagtgagtggacagtacttgatgtctcgtggtgtttcagtggatatgattacctccctgcgtttgttggtgtcgggactctttctcgttggcctggcttatgctacagcgaaagaacagctattggcagttttgaaagataaaaatgccttgctaggaatttttatctttgccatgcttggcttagttcttaatcagacagcctatttacaagccatctatcataccaatgcgggaacggctactgttctacaatatctctgtcctattttggttttggcatatacctgtttgaaaaatagggaaaaaccatcagggattgagttgatttcaattatcttagctatagcaggcacttttttgattgcgactcatggcaaattagatgaattggcagtgactccaatcggtttgttctggggaatcttctcagcctttacttatgcgctatatattattttgccaggtaaattgattcgtcaatacggcagtataacggtgattggtttagggatgttaatgggtggttttgtagtcacgcttggtttgcaaacttggcagcatcgtcttcctattgatggtggaagtttcctgggcctgttaggtattgtcggagtcgggacgatttttgcctatactgcctttcttaaaggcgtcagtatggttggtcctgtcaatggcagtcttttggcctcgattgagccgattgcatctgtcttttttgcagtatggttggtcaatgaacaattttatgcaattgattttgttggaatgttgttgattttacttgctgttttgcttatttctttaaaagatatattggttgcccaaaagagtattggttaatatactcttttttgttatactaaagaaaaaacttgaaaggaataaagatgattaaagaattttgttccgaaaatcatgtaggtgtgatgaaggccctatccctaggagctaaacggattgagctctgtgataatttggcagtcggagggacgacgccgagttatggagtggtcaaacatgtttgtcaactggcccatgagaatgaagccacagtcatgaccatgattcgccctcgcggtggagatttttgctacgataaagcagaggttgaaatgatggttgaagattgtaaagcagcgattgaactgggggcagatggtctggtttatggtttgttaaccgaggaaaattggttggacgaaccagccttggaaagactgtttgctgtttcgcaggactgtcagattgtctttcacatggcttttgaccaaattcctcgcgaacgccaattcgaggctcttgattggctggtagaacatggagtgacacggattttgatgcgtgggagtctgacagggtctgccttgaacaatgtggaatggttacaggaaattgtcgcctatgcacaaggtaaaattgagattttgattggtggaggattgactgtggacaatgtgccaacgttattagaagcattaccaatcaatcaagtacatggaacgagattattttggtaaggtagctttgaaagtgaaataaattacagagtaataatcgaagtttattcagaaatgtttagaagttaaggtttgtttaagcattggaagatacaatatatttattctttttcatataatctccacggaagcagtcgacatgttcggctgttttcatttttgtttgttaaagtccggtatacagactagaaactgctgcgtctctattgaatcccctacgtaaagaattgagaactgtggctgttgaggtgagtgatttagctttggactatgctgttcgtttagcccaatccttgaatagtactttgcgttatcataattatgatagcttgattgccattgctaaaaccaaaggagtagaaccgaaaggtaaggattgtcaatcattttcagagtacagacagcgttacagtctctatgatgctaagaagttaatttatcgcgctctcgcgtggcgtctattcgatgatagtcatgcagattatggacatgctcttaccattttggggttggatgaggatgagtcaggagtagagcaaatcggttttgctttttcaaaatttactcttgatattgattgattgctaacccatatgattttcattccgaaagattggattttggaagaaggtcagatttaattcacaactaccattacattacctccagaaggcactcggttgatccgagtgttttctgctatcgattcgcatttttcttagaaaaatggtataattatctgataaaaaactttggagacgacagtgagtttagaaaattacatgccggattttgccttggaaaaggcttatgacgtgaccgtcgaaagcttgaaaaaacatggcataaaagtagtgtttgttgacttggataataccttgattgcttggaataatcccgatggtacgccagagatgcgccagtggttacatgatttgcaggacgcaggtattcctgttgtggtggtgtctaacaataaatacgaacgtgtcaaacgggcggttgaaaaatttgggattgaatttgaagccttcgctctcaagcctttcacctttgggattaaccgtgctttgaaacgctttgatgtccagccgtatgaggtaattatgattggcgatcagctgatgacggatattcgggctgctaagcgagctggtctcaagtctgtcttggtcaaacccttgataaagacggactctatcaatacgcagattaaccgttggcgtgagcgacggactatgaaaaaaatcatcgctaaatatggagcgatagactacaagagggagatgtaagtggaagaattattttgtatcggctgtggtgcccagattcagacgctagacaaggctgtcgctggttttacacctcaatcagccctagaaaaaggcctggaaacagggcaactctactgccaacgttgtttccgtttgcgccattacaatgagatttcagatgtcaatatctcagacgatgatttcttgaaactcctccatagcgtaggagaaagcgatgccttggtggttaatgtcattgatatttttgatttcaatgggtcagtcattccaggtttacctcgctttatttctggaaatgacgtgcttttggtcggcaacaagcaggacattttacccaagtctgtcaagacaggcaaggttactcagtggttgaccgagcgggcacatgaaatcggcatgcgaccggttgatgtggtcttgacttcagcccaaaataagcaggctatcaaggatttgattgaaaagattgaacaacaccgcaagggacgggatgtctatgtggtcggcgtgaccaatgtcggcaagtcaaccttgattaacgctattattcaagaaatcacaggggacaaggatgtcattacgacttcacgtttccctggaacgacgctggataagattgaaatccctctggatgatggttcatacatctatgacacgccaggaattatccaccgtcaccagatggcccattatttgacggctaaaaacctcaagtacatcagccctcgcaaggaaatcaagccaaagacctaccagctcaatccagaacaaaccttgttcttggctggtctgggacgatttgactttgtggctggtgaacgccaaggctttacggccttctttgataatgagctccaactccaccgcaccaagttgcagggagctagcgagttttatcagaaacatgcgggctcacttttagtgccaccaaccagcaaggaattgaaagaatttcctgaactggtccgtcatgaatttaccatcaacgagaagacggatgtggtcttctcaggacttggttggattcgtgtcaatgaaaaagccaagattgctgcctgggctcctaagggtgtggatgtggtcattcgcaaggcgattatctaatactcttcgaaaattaaaagcagacgttgttgacttgatttgatgaactccagttctatctgcatctgcgtcgcctagtctgattttaattttcattgagtataagaggtatttgatttcagtttttacaattaaagagaaaggaagttcaagtcttctgatttgaacacgggctaagtatatcggcgcaataaggaaaaactttgttttctttatttcccgattgtaacagtctcccagtctgttacaacgccctttgtgtataataaattatgctaacttcaaaacaacgtgcctttttgaacagtcaggcacacagtctcaaacccatcattcagattgggaaaaatggtctaaatgaccagattaaaaccagtgttcgtcaggcactggatgcgcgtgaattgatcaaggtgaccttgctacaaaatacggatgaaaacatccacgaagtagctgaaatcttggaagaagaaatcggtgtggatacggtccaaaaaatcggtcgcatcttgattttattcaaacaatctagcaagaaagagaaccgtaaaatttccaaacaggtcaaagaaatctaagaaggagagcctatggctattgaactcttaacaccctttaccaaggttgaattagaggttgaaaagaaagaaaccaatcgcaaacaagtggggattctgggagggaatttcaaccctgtccacaatgctcacttgattgtggcagaccaggtccgtcaacagttgaagctggatcaagtcttgctcatgccagaattcattccacctcatgtggataagaaagaaaccattgacgaataccatcgctattccatgctcaagatggctattgcaggtattgagggcttggggattgaaaccattgaactagaacgccgtggtgtcagctatacctacgacaccatgaaattgctgaaggaaaaaaatcctgatacggattattatttcatcatcggtgcagatatggtagactaccttccaaaatggcataggattgatgaattggtccagttggtgcagtttgttggtgtccagcgccctcgttacaaggcagggacgtcctatccggttatctgggtagatgtgcccttgatggacatttcctccagcatggtgcgtagttttatcaagcaaggacgggtgccgaattttatggtgcctcatgaagttctggactatatcgaagaaaaaggactttaccaatgattgcagcagatttgacatttgatcgtcaggctcttttggaaaaaatccgtgtagccatgaagccagcgcgcttccaacatgttttgggtgtggagcaggcggcgcttgtcttggcagaccaatatggctgtgatccgaaaaaagccagtctagcagcactcttgcatgactatgctaaggaagtggaagaccaagtttttttggacttaattgccaagtatgatttggacaaggacctgctcaactgggataataacatctggcacggtgtggttggcgcctataaaatcgcagaagattttggtttggaagatgaggagattttccaagccattcaacgacacaccgttggggcggggcagatgaccttgctggacaaggttctctatgtagcggactacatcgaacccaatcgggattttcctggggtggacgaggcgcgtcgtatcgcaaaagagtccttggacaaggcagtagcctatgaaactgcccaaaccatttcctacttagccaagaaggggattcccatttatccacaaattttggaaacctataatggctatgttgtttggttgaaggagtagggatgattacattatagtcatttagtttttcttttattacttcgttaactcgctttgccgtactccagtacagcctgcagctcattgcctagtactaaaagtaaactaaaaggctataaaatatcttgatgaacgttcctatcaagcagtcttagacttgacagtagccgaggaggacaagggcttcgtggctccaaacgtgcgttccttggcggatgcctggttatatagagagaatgggagtgggaaagaactcgatgggttctaaaagagttcgtcaacaagtccttatttccagttgttgagctgaaacagtctatccccagactgtttcactcccaccccccgcacagctcaaactgtctgggagacagtttgaggttggagatgaagcgaactctgttcgcatcagtcgtagaggccagatttggagtgtgtagcacgaacaaagctgccaatcaaccactgcgctgagatgttgactagaactttgagaagtgtacttgcactagaaccttgccccttatgccatctgggcggatgaacaggtggttggttttgccttgattgacattgatgaagacatccagcagtatatgctctggcgatttatgattggccaagagtttcaaggaaggggctatggccaggcggctttggaagtcgtaatagcaatggctcaatcacatcctgtctgcgaccatttgattgcagcctatgttaagggcaatcagaaaatggctcatctcttggagaaaaataattttgtcttggatagtgaagaagaaagagaattggtcttccgtttggaaacgcctggtgttcagctatgaaatctgcattgttagtcattgacattcagaaccttctagtggaggaaaaaccttatgccattgaagagcgattagccctctggtaagatagccttgcacaagcccgtcaagcggggctagaagtcatccatgtccgccatcatgatcaggaattggtcaaggggactgcttgactgggagattcactcaattgttgcacccttagctagtgagaagattttcgataagtcctttaacagtgccttcaaggaaacggggcttcatgcttatttgcaggaaaaggaaattgagcgactcattatcatgggcatggcgaccaatttttgcattgatacgacgattaaagtagcctttgaactaggctacaaggtagctgtgatccagggcggaacgacgacaggttattcaggtaaattggacgccgaagacttgattgaccactaccaaaacatctggtcatggaattttgcccaggtggatagattagaaaatataattagaggataagatgaaagaactagatttagtaaaagttgtggttcaggctgctgatgacaagcgagctgaggaccttgttgtaattgatgttcaaggcgtgaccagcctgacagactactttgtgattgccagctccatgaacagtcgccagttggaggctattgcggaaaacatccgtgaaaaggtagcggatgttggaatcaagagtagccgtgtagaaggcgatagtaacggtggctgggtcctattggatcttggaggcgtagtcgttcatatcttctcagaagaaatgcgtgacctctacaaccttgaaaaattatggcacgaaggcagcttcttggaagtcgcagactttttagaagaggaatagtgaaacagtttggggaactgtttcagctggtcaccataaaactcgaaagtgaccaaagagagttcactattatgtaattagaagtgatgaacttcttgaaaaaatatgaagatagattttgatttgggtgcactatttgaaacttaagtcaacatctcagcgcagtggttgattggcagctttgttcgtgcttcccactccaaatctgacctaatcaactgtgcgggggcaggaaaacgaactctttggaattgaggagttctttcctgctccctttttatgaaaggaaaaatgggaaaatatggcaacttatgaaacatttgctgcggtctatgatgaaatcatggatgacagcttgtatgataaatggacagattttagcttgcggaacttgccacaagacaccaagacaattttagaattggcctgtgggacagggattcaggctgtacgttttgctcaaaagggctatgaggtgacagggcttgacctgtcctatgaaatgttggaattggcccagaaaaaagcagaagctgctggtgtcatgatggaattggcccaagcagatatgatggctctggaaggtgtgggagatttcgatgcggtgacctgttattcggacagtctgtgctatatgtcggaccgagaagccgttttgcgggtctttgaaggcgttcactcggttctcaatcaaggtggtactttcctttttgacgttcactccatctatcaaatggaggaagtctttgcaggctatagctaccatgaaaactacgaggattttgcctttgtctgggacacctatgagggggagcatgcacattcgattgttcacgaattgaccttctttgtcaaagatgaagccagtcaagaggagcggtttatccgtcgggatgaagtgcatgaagagcggacttatccgattgaaacctatgtggaattattgaaagaagctggttttgcatctgtggaagtctttgcggactttgaagatgaagcaccgacagaaacaagccagcggtggtttttcaagtgtaaaaagtaagatttaaaattaaagtgaagttttcgggtcccaccaaattagagtgggattttgtgatataataaaaataaatatatctgtaaaggaaaatgacatggagagtttacatcgtaaaatcagtaactggggtcaaaaaatattccttcagttcaaaaatagaactcctaatgtggaagggataagttttaatagactgacctctaataaaaatatagatttggaaagggaaaatccaagctttaaacaagcactagattttgcaatccaagatgatgagttaaaaaatgtagcgatcacgggaaattatggctctggaaaaagtagtttgcttgattcttatgaagcgaagtactctaataaaaaattcctccatatttctctagctgactataaagaaaatgatttatcaggctataaagaaaatgattcatcagagtcaggaaagaaactaaatgtacgacagattaatgtgattgaaggcaagatcataaatcaattacttcatcagattcatccaaaacatgtaaagaaatcgatttttaaaacattgtctcgaactccaagaagaataccgcttttattaactgtatatattgtactattcttcattacactttcttattttttgaaacccaattttttaaaagctttagtcactgctgacaaggtatttgggtgggatgccaataccgtatttagctggttatttttgattcttctttttattggctcccttacaacgatttggtatatagttgaaaataagacgataaaatcattgacaattggtggcaaaaatgtttcatcagagattgatattttttctgatcagtcgatgagagtttcctattttgacaaatacctagatgatgtgttgtatcttttgaatgaatcaagagcagatgtcattgtttttgaggatatcgaccgttttgagaataacactatttttgccaagattaaggaactaaacgtattagtcaacaataagcgaaaaatagctaagaaatcatcaaagctagtgtttctttacctgatacgagatgatttattcatttcaaaagaaagaactaaattttttgattttatcatcccagtccttccagttattacgagttcaaactctagcgataagttgacaactactttaaaagaaatgggaataaaatcaggattagcggatgacttcctcttcagaatctcgctttatatagatgatatgagattgcttaataatatctgtaatgaattttattcttatcagcttgaattgacacatgacaagacgggtgagaaaaatgcattggatcttgatttgaaaaaaatatttgcaatgattgtctacaaaaatattttcccgaaagacttttctgagttgcagaataatcaaggttttctatattcattgtttaatgagaaagaagttagaagaagtgaaaaacttacgaagattgatagtgaaaaactgcatttagagaataaactgagaaagattcagagtgagcacattcaagatgaaattgaactctatggaacaatttttaaaattccaaatgggagaaaggttgtcagtgtcaatgacaaatttcaagatgagtttacttcttatcatgattttatttctgaaatgctggtggaaggaagtcgtatcatctcctatgtggattttgatgatgcttaccgtaatgtaggtattaaaacagaaaatatggattcaatttttccagagaaagattctccagagtttaaggaacgccttgatactgtaagaagtcgcaataatagtaaagagttgcaacaaaaaattgcttcattaaatcaaaaacggagctttgttgaaaaacaattgattgcggacatctatactaatcaagaaatacatgaatttgctaagagtagagaagaatttattgatatagaaaaaaatcagcaatttgatattatttacttcttattgaaaaactcttatatagatgaaacctatccagattatttgacctatttttatggcaatgtcttaactaagaatgataaagaatttttgagaaatatttccagtggaagaggtgcaggttttgatttcagactggtaaatatttcaaatatctatcatcatttgcaattaaaggactttagaaatgaagaagttttaaattttgacttgattgaatacatgcttaaaaatttggagttgcagagtcgagaagaaaacttgagtgctatcttattacaagaagataacttggattttttggttgaactggcaaagaaattgtatgatagtaagtctgaaaaatataacttggaacagtttgggcagttgatggagttttggctatctactaatccacaaagatttattgactatatgaagtctacgaaggtggagtatcaagctccactaaagaataagttcattcgagctttgatgaatcaggtgaacttagatagtgttgataatgaaataaaggcgttagtagctcgttatatcaatgaaaataatgatttaatttcaccaaatgaagattttacatcatttttcaaaacaaaccttaaggcaatcaatcttaaattcactcattttagagagcctgatgatgatgctcccagaactacgaccttcttggagcttatcgactttatctttggcaatagtttgtatgagataaataaagaaaatttaagattttttatgcggtggtttaagggaagtactgactggtcagaggaagacttcaagcacaagaattttgaactgcttcatacaaatgataattattcaccgctgctagagtatagtagattgaagataacagactatgtctatgcatatttagagatttgtgaggggactattttagataactcggaatatattgtagaactacttcaaagaaacgaagtttacgagtctggatttaatttgggaacactggaggaagaacgccaaattgatagaattttacagttccttccggataatagtattaatttcaatagcgatgatttccgtcaacttgtagaagaggatattcttgaagaggggaattatcttaccttgctaagtttactagttcaaacttctaaagccgtagtggatactgatattatcttatcttattttaccgagaatcagaattatgataatagtcttatcaactttatcaataatgcaagagatttaaaatttgaagaggatatatttaacttacttgagaaagaagaacaaagaaactttttcaccaaaactgttgagtgtatggagttagatgacaccaaatatgaactcatacttagcacacttggttggcactataccgatacatttaataaaagtggaatagagtcaagtaagcttagaatattaattgatttggaaattatacagtttaactctaagaacattgaatttttcagagataattatccagaggatacactatacctaatcaagaaacacttatcggaatatctagatactaaaagtaaaatatataaggaagatgagttgttagcattacttgatgatgacattatttcggatgatgagaaaactaacattgcagaccatattttaaaaatcagtataaaaaataaacagtattcagaaaaattgactgctcatattttggaaaatcagtttgatgaagaggatttgagttatatcatcagtagtcaattctttgacaaccagtcactgagtttgaaagagctagttaaacaaattgcaattgaaaatcttgatactatagctgaagaattttatgcccaaattagtaataatttaatgagaaagctaatcgctgaaagtcaattaaatacattaaagaaattaatttataattactatgtatatacaccaaatttggatgagaatgagaagcgagagcagttttctaagtatttgaatctatttgctctatcggataatattacagctttaaaggaactcaatgtatttgatgagtgggatagtgtattgaaaacattaaataaaccagggactagatggggacaagtgcaaaaaacaacaataaacttggcatttgcaagatacttagatagtaataattttgtaagctcaattaacgaacgaagtaacgatatccgcttaaatagctacaaggataaaactatacctttgtagacctatgttagactatgatagagttgtcgaattaaaatacaaaaaataggagaaatgcatgtctatttcagggataatagcagaatacaatccctttcacacggggcataaatacctgctggaacaggccgaggggctgaaaattgtcgtcatgtctggcaattttatgcaacggggtgagccagccattgtggataagtggacacgggctcagatggctttggaacacggggcagatcttgttgtcgagatgccctttttggtgtcggtccagtcggctgaccatttcgccaagggagcaatcagcattttacacaggctaggtgtggaaaaactggttttcggtacagaagaaatgctggattatcagaaaattgcggatatctatgtggataagtcggaagagatggaaaattttgtgaaaaacttgccagacaatttctcttatccacagaagacccaggccatgtggcaggaatttgcgggtctaaccttcacaggtgatacgccaaatcatattctggctctggcttatgctaagggggtggctggaacaggcattcagctcagccctgttcaacggcagggagctggttttcattcggaagaggtggaaacgtcctacgcctcggcgatagctatccgaaagggtgctgaccagctggacttggttcgtgactttttaccgtctgccagtctctttgaagaggcgaccaaggtaagctggagaaactattttcctctgctccgctaccagattacgacccacccagatctcagtcaggtctttcaggtgaacgaagaactagccagtcgtattcgctctgccattgggagcgtagcgaccgtggaggagttagtggaggccgttacgaccaagcgctacaccaaggcgcgggtgcggcgggtgttgacctacatcctgattaatgcggtggaaactcccttaccagatgcggtccatgtgctaggcttctcggctcgaggtcaggcctatctcaagcaggtcaaggagcgagtgggcttggtgacgcggatcggtaaagagccctgggacagcctgacccagcaggcggatttggtctatcaactgggcgctgacgcaatggcagagcagacctatgggcgcgtgccggtgagggtggagtgagaatctgagttgaaaatagaaaatttttataatttttcccttgactctaacgctgggtcatagattatactgctatttatgagaggagattatccatgaaaacagtgaaggaaatgagtcagctttcaggtatcagtgtgcgcacacttcattattacgatgaaataaatttgctgacacctagttttattgcggaaaacggatatcgttactatgataatgaggcgtttgaaaagttgcaagaaatcttactttttcgtgaattggaatttcctctcaaagaaattaaaaaaattgtagggaatgcagcttatgatagagagtcagctttgaaagaccagattagattactggagttgaaaaagaagcacttggaaaaagtcataaagcatgccaagtctttacagcagaagggagaaaattacatgaattttgaagtgtttgataagtctgatttgttggctttccaggaggaagctaaagaaagatggggtaataccgcagcttttcaggagttttctgctaagacgaatcaggaagggtttgctcatataagtgcagaaatgtctggtattatgatggaatttggaaaaatgaagagtttatcagctgatgattctaaagttcataaacaggtagaggttcttaaagcttatattagtgagaatttttataattgtaccaatgaaattctagcaagtctaggacaaatgtatattgcagataaccggtttactcaatttattgatcaagtgggaggagaaggtacagcgtcctttgtcagtcaggcaatagcagtttattgcaaagaataaacgaaagaagtctagtgagaactaggcttttttagtattatgaaaacgctttatatatggtataataaaacatagaataaagatggggatctagtatgacaaagataaaaataatcagcaatccatttcataaaagtattgtttttcaaaagcaacaaccgattacagaagtttgggaggaaattacatttgaatccaatccaaatagtcgtttggtaagggaaaatattcaaaaaggggtgctatcatttcatatccaagaaatagtagatattctggtggcagaatatgatgatggaacagggattgacttgttatttgaaggaaatagtgatgaatttcaggagttgaaaacatttgtccaatcgttaaataattcttctatttctttgaagaaatctgcttatagcttgacaaatgcacgagatattctacctgaagttctttctatttttgataaaactcaggtcattcttcctgaagaacttgaacatgacgcagccatacaaaagtttcaagatgcaacaaaacctcagattccattattggttttgggaaattatagtgcagggaagtctacttttatcaattcattggtaggatatgagttattgcctgccagtgaccaacctacaacagcgaaaattatacaaattgagaaatttgctgaaaaatggattgaaatagaaggaacacttctaagaaataaggtttgtatccgaattgatgaggacggctttgaggttgaaggcgacaggattgatgagacaattatcaaagatttagaatccattcgtcagagtttgccacaaacaactccgcaaatactagcacgggctgtgttggcttatttgaatgctagggaagatagtgatttgaatattatcactgtgaaaacagcgtttaccgatagtccactgtcaaaatcttctcatcgctacatcatatttgatactccaggttccaattcttcgaccaatatggagcatttgcagcttcttcgtgaggctatggcgggtatgagcaatggtttgcctatttttatatcggaatacactagcttagatactgtagacaatgataaactctatcaggaattagaacaaatagacggaattgatttacggtatacaatactagttgttaacaaagcagacactgcggccttatcaacttttcaagatcatcaggtattaaatcaagcccttccaagaaaattatcaacaaaaagagtttatttcctatcctctctaatgggcttggggtcaaaaaccagcggtcttttccaagagccagattatgagagagtttatcaaaaaagtttggctgagtttacagacgcttcaaatccttattatcaacagttgtatacttataatattcttccaactcagcagaaactggctcaggaattgcagtctaaggaggagagaaatcttctctatgccaacagtggactgtacagtttagagtcggaaattgaggttttttcaaccaagtatgcggcttataataaatgtgtacaggcggaccagtatttgcagcatattatttctcaaacgcagtcaatcattgaagattccaagaaaacaattgagcaagaaaaagatcgtttagagaaaaagttggagaaagacaagctggcattggtgaatgatttaaaacgccaacaagctgattttttcaattcctcatcgacggtataccaacaaaacttgaatgagaaagtaagggatgagaaacattatgctccgttacaactgttcataaaagagcgggactctctatggagtaaggcagttgatgattttcaattgaaatcctatcaaaaagaaatggcagaatctcctaagaaagccctaaacaatatcaagaatagtttaggaaaagcctgggataagaaaaatattgaaatcctaggttcagcatttgtaaatggttttaacgatacgggaaaagtgttttcgaaggttgatgactataataaaatgaagaccaaggccaaaggtcaagttcgggatcagttaattacttttgcaaggtttgaatacattaaacaagtggaagaggttggaaaagactttacgactctgtcaattcattattggaaggagcagacaggattgattaaagatagattttctcagctcattggtgatgcgtccgtattgtcagatcaaaagcgggcggctattaaagaaatcattttccaattccagcagccagttttgtaccatgattccaagcaattatttgatcaaaaatcattggtagaaggattccgtttgggagacatccagatatttggtgatgccaacaagatcgatttacaaaagctagaaaaacgctataatagtttgttaaaaactgcttacaagcatatcaatgagcaattgattagtcaccatcaagcgactttttataaatgggttgaagccttattgcatttggtaacggagaatattgtagagtttagtccagaccttcattctacgaatttgttaatacaggacaaccgagtgaagattgaggaattatcaaccaacttgcaaaatctacatgagtattctaaggacttgcacgacttgatggcatggaaagatgatgaggaagtagcaaatggttattaagaagatgataaaaaaagtagctaccaaggcagcagacggtgtttcaaaattatcagaattgagtccagagcagcttgaaaaagtgcaggctcaaatggcgacttatcgggatcaaattcctgatttgtcaggtgaggctgcggaggaatactttaggaaacagttagcaattgctggcgtagaagtctataatgcctatctacctcagttaaaagacctttatcttccgattgacaataaaacggaatttcgtttagaagatgagggagttttgatcgatgaaggcgaatttaagagtggttataatatccgctacatcaacattaccaagtgggtgacggataagcaggaaaatagtttggagaaactggtcagtgtttatgaggtcttgtcaacaactccttgtaatatttctcttgttttccaccgtaaacaggaggaaacatctgtatatttagcggtcactaacactgaaaatgcggatagtaatgcagatgttgatagttaccgcaagcgattggtctcagctatcaagggaaattttccaggtgcagcttggaaagaggaggttggaagaggtagcctgccttgttttgaggactatattccctactcagtagcaacagcttctaatattccaacggagaaatcagagaagttcatcagtcagacaatcgaaaaattattggatggcattgtacctgaaaacaaagaacaagaatacattcttgtcctcctggcaacgccagttttggatgttacagatagaaaattgcatctttctcagatttattctaacctatctccttatgccacttggcagacccagttccaattgacagaatcagattccagaggctcttctgcaactgttggggttaatattggtgccagtgtcggaagccagacaggtcacaatctaacccaaacccattcgcaaggtcaaactgagtcaagaggaactagtgagacggagaccaataccaaaggaagtggttggcaagcaggtgtaaatattaaaatactcaacggaggtcataattggaacaaaagcaaatcaatcgccaaaggcatcaccaatacaataggcaaaacagcctcggttgccaatgccgttgggaaaacagtttctagcagtctaggtgccaattttggagctaattttgctcgaacttccagtgtgactgctaccattgggaaaaatgaaggcattagtcagtcctttgtcaaccaccatgttcagcacgctctaaaaaatttagacaagcagatggagcgtttggaattgtctactgccttgggactatgggatttttctgcctatgttttgagtgaagatccaactattgccaataacgttgcccattcctatttggccttgactcagggagaagaatcgcatctgtcgcaaacagttgtcaatctttggcgtggggatgttcaaatggaacgtgataaggctaaagcactgactgcctacttgagagatttacgccaccctctctttggtttcaacccagaaattctagagattgatgaagaatttgcagtttatccagaaatcgtcacagcagccacgccactgtctggaaaggaattagcctatgctctcaattttcctcagaaatcgattgccggtcttcctgttttagagtgtgctcagtttggtcgtaatatctctacttttgaggagaaagatgatcaggagcaacttcctttgggaaatattttccacatgaatcatgaggaaaatacagcagttcagctttccttaccttccttggcctcccatacatttattacaggtagtacaggtacaggtaagagtaataccgtctatcaattgctcgctcaggctagggaaaaaggaattaaatttttggttgtagagccagctaaaggagaatataagcaggtttttggctcagatgaggatgtggcagtttttggaaccaatccaactatcactcccttattaaaaataaatccattcagcttccctgaaggcattcatatcctagaacatttagaccgtcttgtagaactcttcaatgtttgttggccaatgtatgcagcgatgcctgctgttttgaaaaaagccattgaacaagcctatcaagattgtggctgggatttgatttcgtcagtgaatacttattcaaaaaccattttcccaacgtttgcagatgtcttacggacaatcagagaaattatcgactcgagcgaatacgacaatgataataagggagcctataaaggagctttgctgacacgcttggagtcactgacaacggggatttaccagttgatgtttacagaagatgagatttcatccgagaagttatttgatgaaaatgttatcgtggatttgagtcgtctgggttctagtgagaccaaatcgctgataatgggtctcctcattttaaaaatgcaagaataccgaatggtttctagtcagggtatgaatcagcagctccgccatgtgactgttttagaagaggcccacaatctcttgaaacgtacatcaacagaacaggcaaccgaatctagtaatttacttggaaaaagtgtggagatgttgaccaatgccatcgctgagatgaggacatatggagagggctttattatcgcagatcagtcgccaggtctcttagacttagctgttattcgtaataccaataccaagattattttgcgcttacctgaatattccgatagggagttggttggtaagtctgctaatctaaatgaagaacaaataaatgaattggccaaactgccgaaaggtgtcgcagcagtctatcaaaatgaatggctggaaccagttttatgtaaggtggcaaagtatgactcaactgaaatggtatttcaacaaccaacccaattagtaaggacagaatcaccctatcaccgcttggctattttagaattactgactactagcccaaacctagatagcaccttgtcttttgaagaattacaagaattaactctagcagtaggtcttgatagtttgactcaagtaagaatctttaacttcttacgaacaacatccccagataattttagtatgcatgaactggcgcacattctcgggaaagtatacccagaattagtcgagaaaattcggttgaaagcagaaaaagggttagagccacccgctttgacacaggtacttcagcaggaaattgacagtagtatacctgagacgatcagtgagcaggccagacgggatttagtacagggcttgatgacttgttattatttatttgaactaaaagaccacaaggccatgcaggattggttacgaaatggagacttaatatgatagaaggattgaaaactgttgcggaggcagttaagcctgtcgtaaatgaagttggcaaacgagcgatagatgcctttgaaaagccgatagattcagataagcgattggaagctgcatctgataataaaaccacttttcgctatgatggtctgagcaagcctcaagaatttctagctcaagcccaagggtttcccaaagagatagctaaggatatttacaattctcaggaactcaagcattatatggacataggaatgcgagctgtgcaatttggacagaaagaaaatggggagccacgattttgtcttattccaaaagatttatcgtttgatagagttgtagactcacaggggcgaaccaacgcagagcgattgcaaagtggattactaccgataaaggatggtcaacctttagaagttcaccatatcggtcaaaaaaacggtggtcattatgccttattgacgaaagaagaacacattaagaatgggaataaagaaatgttgcataagccaggtaaatctgatgttgatcatagtttagattttgctagagataagcgatcaattactaaagtacttatggaggaacaagtatgagtcagttagtagataaaataaaagtagtccaaggtctttatagcggtagccctgctagtgagcaagaagtggcagtggctgagagtaagcttcagttgatatttccagcagagtataaggactatttgaaagagtatggggtgatttcattctatggaacagaatggaatggattgaaaggagatacttggaccgatgtagttgcaaccaccttggaagcgcgtagtctgtatgaaaattttcctaaagagaaatttattttagaggatctacattttgatgatatgcttgttttagcggattcgactggtaaagtctttttgtggcacaatggattagaaaaagagattcattcctcaattgcgtcctatctggaagaatgtgtagccagaaaggacaccccatgattcaacctattatgaaagatattttcttcctgcagcagaagtctgagcctgcgactcagctagatgtgcaggtcggtcaggacttgcaggacactttagcagccaatgctcatgcctgcgtgggcatggcggccaacatgattggcgtcaaaaagcggattatcatcgtcaatatgggttttaccaacctggtcatgtacaatcccgtcctcatcagcaaggccaagccctatcagacagaagagggctgcctgtcgctggaaggtactcgcccgacgacacgctatcaggagattgaagtggagttttttgatgcttcatggaaaaagatcagcctaaagctgacagacttccaagcccagattgttcagcatgaactagatcatttggaagggattatcatctaaatctaccgtcaggtagatttttttgtataaaagtcaaaaaaggtcaaacaaaactattgacttttactgaccaatgatgtaaaataagattcgtaaggtaaagggccttacaaattctttgaacaaaaggtcagtttaggtcaaacaaaaaagtttgaccgacaaattgactaaatggtcagtaaaagacaaacttctaaggaggttgctatgaaagacaggattataccctattaactatttttttatcacaaaaaggtcagttttggtcaataaaaacataacatgaaacgaggtaaaaactatgaacaacaatttcaataactttaacaatatggacgacattttcaatcaactcatgggcaacatgggtggctacagcacagaacgtcgccgttattctatcaatgggcgtgaagtgacaccagaagaatttgctatgtaccgtcagactggtcgcctgccacagacagaagaagtggctcaaacacaggctaaaggtcagataaagtcagacggaattcttgcaaaacttggtcgcaatttgacacaagatgcgcgtgaaggtaagttggatccagtcattggacgaaacaaggaaatccaagaaacctctgaaatcctagctcgccgtacgaaaaataatcctgttttggtcggtgatgctggtgtcggaaagacagcggtagtagaaggattggctcaagccattgtcaatggtgatgtgccagcagccattaagaacaaggaaatcatctccatcgacatttcaggcttggaggctgggactcagtatcgtggagcttttgaggaaaatgtgcagaatcttgtggatgaagtcaaaaaagctggaaatatcattctcttctttgatgaaattcatcagattttgggagctggtagcactggcggagactcaggttccaagggtttagcggatattctcaaaccagctttatcccgtggggaattgacggttatcggtgccactacacaggacgaataccgcaatactattcacaagaatgctgctctggctcgtcgtttcaatgaagtcaaggtcaatgctccgtccgcagaggacacctaccagattttgaaagggattaagccgctttatgaagcccaccacaatattgaattgccagatgaggttttgagagctgcggttgattattccgtccaatatattccacaacgtagcttgcctgataaggctattgacctagtcgatgtgaccgctgcacatttggctgcacaacatcctgtgacagatattcagaccttagaagcagaaatggctgaggcaaaacagttgcagttggaagcagctgaaaaagaggattatgaaaaagccttgaatgaaaaagtccgtattgataagctacaaaaacagattgataatcatacggagcaacagaaagtggtggcgactgttaatgatgtggctcaggcggttgagcggatgacaggaattccagtctctcaaatgggagcttctgacattgaacgactcaaggaattgaaaaatcgtctggcagcaaacgttatcggtcaagacgatgcggtggaagctgtatctcgtgccattcgtcggaatcgtgcaggttttgatgatggcaaccatccaattggttccttcctctttgttggtccgacaggtgtgggtaagacagagttggcaaaacagttagcactagacttgtttggtaacaaggatgccattattcgtttggatatgtctgaatacagcgatcggacagccgtttccaaattaatcggtaccacagctggctacattggctacgatgacaattcccatactcttaccgagcgcgtccgccgcaatccgtactcaatcgttcttatggatgagattgaaaaagctgatccacaagtgattacccttctcttgcaagtgctagatgatgggcatttgactgatggacagggcaaccaagttaactttaaaaataccattattatcgcgacttctaatgcaggttttggttatggaatggcagaaggtgaagaaaatcaagacatcatggaccgcatcgcaccattcttccgcccagagtttctcaatcgttttaacgcagtcatcgagttcaagcatttggataaagatgatctcaaagccattgtagaattactcttggcccaggtcaataataccctggcgaagaaaggcatccaattaacggtaacggaagctgccaaagaattcttgatggaagaaggctatgacaaggccatgggagcccgtcctctgcgccgtgtgattgaaaatcagattcgtgataaggtgacggatttctatttggatcatgttgatgtcaaatatctggaagcggatgtggttgatggaagcatccaaataaaagagcaaagctttgcttaaaaatagtgaagaatttgaaaaatcggatagaaatatctgattttttcttttttgttattcgctaacaaatgctataaaataggctttctagagcacattaaaactttttttataaaatccttgacaagtgcaaacgtttgcgttaaactatattcgtaaccgacagaaaggaaaacgtttttatgacaaatcgtaccagtggaattttgatgcatattacctcacttccaggtaagtttggtattggtacttttggacagtctgcctatgattttgtagatttcttggtggaaaccaagcaaacctactggcagattttaccactaacaactacaagctatggagattctccttaccagtctttctctgctattgcaggaaatacacacttgatagactttgacctcttggttgaagatggcttattggcaacagaagatttccaagatgtaaattttggagataatcctgaaaaagtagactatgctcttatctatcaagttcgtcgaccaattttggagaaggcagttcaagcatttttacaagatgataagaagaaagctgcttttctagagtttgaaaaggctaactcatcttggttgacagattatgcggagttcatggctatcaaggaatactttggtaataaagctctccaagaatgggaagataaaaaagttgtagctcgcaatgaggaagctcttgataagtaccgcttagaattggcaaatcaaatcgactactacaaagtcacacagtatttcttcttcagccaatggaaacaattgaaagaatatgccaacaaacaccacatcaaaatcatcggagatatgccaatctatgtttctgctgatagcgttgaagtgtggacaaaaccccaactattcaaattggacagtgaacgcaagccgctttatgtagcaggtgtaccagctgataacttctcggcagatggtcaattatggggaaatcctatttacgattggccagaacatgaaaaaacaggctataactggtggatttatcgtatccatgaaagtttcaaactttatgatgtccttcggattgaccatttcaaaggtttctcagacttctggcaagttgatggtaaggcagaggtggcaaaagttggaacttgggaaccaggtcctggctacaatctcttcaaggctgtcaaagaaacacttggagaccttccaatcattgcagaagaccttggaaacattgacgctaaagctcgcaaattgcttgcggattgtggctatccaggcatgaaaatcttagaatttggtttctttgatgtaacaggtaagagtatcgatgctccacaccgttgcattccaaattcagttgcctacactggaactcacgataatgaggttgtcaatggctggtacaacaatcttgatccagaacaacaagaatacgtggatgcctacagcaaccgtaagccgattgaaaaagttagccaagctatgctccgtatgctgtttgcaacagtgagtgatacagctatcgcaaccatgcaagacgtcctagacttgggagaagaaagtcgaatgaatatgccgtcaactatcggtggaaactgggaatggcgcatgaaagctgaagacttgacccaagaacgcaaagacttcttgacaaaaatgacattactataccaacgaggaaatgaaaaccatgactaaatttacaacatttgcagaaacaaatacttcgaagaaattagctgatttgacaaatgaagaaatctatcttcaactgttgaactatgtaaaagatgcagcagcttcaaaaccaaaaaacacaggaaaacgtaaagtttactatatctcagctgagttccttatcggtaaactcttgtcaaacaacttgattaacttgggtgtgtataaagacgttcaagcagaattggcagcagctggtaaatcattggcgcaggttgaagatgttgaaccagaaccatcacttggtaacggtggtttgggacgtctagcttcatgtttcgttgattctatgtcaacacttgctatcaacggtgaaggtgttggtctgaactaccactgtggtcttttccgccaagtatttaagaaaaatgagcaagaagcagagccaaacttctggattgaaaatgattcttggttgattccaacaactatcagctatgatgttccattcaaaaacttcactttgaaatcaaaattggatcgtcttgatattcttggctataaaaaagagactaagaactacctcaatttgtttgatattgagtcagtaaactatgacttgattacagacggtatttcatttgacaagactgatattaaagaaaacttgacactcttcttgtacccagatgattctgataagaatggtgaattgctccgtatctaccaacaatatttcatggtatcaaatgctgctcaacttttgattgatgaagcaattgagcgcggttcaaacttgcatgacttggctgactacgcttatgtgcaaatcaacgatactcacccatcaatggtgattcctgagttgatccgtcttttgactgaaaagcatggtattgaatttgcggaagcagttgccatcgttaagaatatgactggttacacaaaccatactatcttggcggaagcacttgaaaaatggccacttgagttccttgaagaagtggtgccacacttggttgatatcatcaaagaattggatgcccttattcgtgcagaaattaaagacccagcagtccaaatcattgatgaatcaggtcgtgtacacatggctcacatggatatccacttctctaactcagtgaacggtgtagctgcgcttcacacagaaatcctcaaaaactctgaattgaaagctttctacgagctttatccagaaaaattcaacaataaaacaaacggtatcactttccgccgttggttggaatttgccaaccaagaccttgctgattacatcaaagaattgattggcgatgaatacttgacagatgcgactaaacttgaaaaattgcttgcctttgctgatgacaaggaagttcatgctaagttggctgaaatcaagttcaacaataagttggctctcaaacgttaccttaaagacaacaaaggtatcgagctggatgaaaattctattattgatacacaaatcaaacgtttccacgagtacaaacgccaacaaatgaatgccttgtatgttatccataaataccttgaaatcaagaatggtaaccttccgaaacgtaaaatcactgttatcttcggtggtaaagcggcacctgcctacatcattgcacaagacatcattcacttgattctttgcttgtcagagttgatcaacaatgacccagaagtaaataaatacctcaatgttcacttggtagaaaactacaatgtgacagttgctgagaaactcatccctgcaacagacatttcagaacaaatctcattggcttctaaagaagcgtcaggtactggtaacatgaaattcatgctcaacggtgcattgacacttggtacaatggatggtgccaacgttgagattgctgagttggctggtatggataacatctatacatttggtaaagattcagataccatcatcgacttgtacgataaggctggatatgtatctgcggactactacaatggcgatgccaatatcaaacgtgcagttgactttatcgttagcgatgaggtaaaagcacttggtaacgaagaacgtcttggccgtctgcaccatgaattgatttcgaaagactggttcatgaccttgattgacttggctgaatacattgaagtaaaagaacaagtctttgcagactacgaagatcaagattcatggaacaagaaagttgttcataacattgccaaagctggattcttctcatctgaccgtacgattgaacagtacaatgaagatatttggcacagtaactaattgaattccaacaattagtaggaaagttgattgaaccactccaaaacttatcagatcaattcttcctatgtgttgaagaataaaaaccgaccagtttttaccattattggtactctccttagtatataaatgcaaagaatgtctctgcaaaagcagagacattctttttataactataaaattctagaagttttgtacacttgatcaaaaaaatcgaaagtttccttttaccgtttcgccattgatacaaagctaactttgtctggacggtaactaattgttccatactggaaagcttgaccatttgaaagataggtgatgctagtgaccacgacgaccatgtcatagtctcctaagtccatcaattgtttttcttcttcgtttgcaaaacggaaggaaatttcacgtctggaatgagaaattgttaaatggagttcttcttctaagtagcggtaaatagagctttcggcaatttctttgctgagataagggacgaccctacggtcaaaataggaaatgtcatattccaaccgctcaccgtcaattgtccgtacccgactcactcgatagaaatctaccttatcatcaacttcgaaagttgacattaaatcttcttgaccttgaataatataaagcgaagtaagctgggtctgaatttggtgctgtgatcttttgttcaattcgcccgctgttttaatttcagaaagatattggtccttcattagaccatgttcgataacaatagaagatttcccctgtttcttttgaatataaccatccatttcaagaagagatagtgctttgcgaatggtgtccttggagtaggaatacacttccattaattcattttctgtcggtagggcctgtccagttgaccaaacctgctcttcgatttttttcttaatatcttgataaacttttttatacttactcatagtttcctgtctttctacccattagtgtatcataaaagagctagaaaggggcaatacatctattttatttagtagaatatacaacttttacgtaaaagtttaaaatattacggaaaagctattgactaatgcaaacgtttacgctatactattcctataaaagaaaacggttacgcattttcagagagagggggagcaatgaaattactaacaattaatgtccacgcctggttagaagaaaggcaggatgaaaaactagatgttttagcccaaacaatagctgaaaaggcttatgatgtcatcgctcttcaagaggtcaatcagctcataactgctgatttggtaacgaaagacttgaaggcggataattatggcttgattttattagaaaaattaagaaccttgggacaatttgactattcatattattggagcaactcacatatcggctacgataagtacgaagaagggattgcctttcttactaagttgccagtttatgaagtggatcaattttattgtagtcagaataaatctattgattccatcctatcacgaaaaattatgggattgacggtcttctatcaagaccagttgatcgacctgtattcttgtcacatcaatcttccagggagtgaagaggaagaccagcttgataacattcgtacgattgtggaacggactggcaatagacgttttaagattcttatgggagattttaataccgatgccttctcagatcgagaggcctacgaagcgattacagagctcggtctttatgattcatataatctagcgatggaaaaagaccaggggattacggttgaaaaggctatcgatggctgggctggtcacagtcaggaaaaacgattggattacattttcttaaatcagaaaaaggaagttttatccagcttagtgattttcaatggagagaatcgtccgattatttcagaccattttggtgtggaagttgaaattaatgtataaaatggcacagagccaaaaaataaaggagaaaaaatgaaaaaatttcttagtttcgaattttggcaaaaattcggtaagtgtttaatggtcgtgattgcagttatgcctgcagcaggtctgatggtttctatcggaaactctattccgttaatcagcccagaatcagaactcttgattcgtattgggaatatcattgcccaaatcggttgggggattatcggaaaccttcacttgctctttgccttggctatcggtggaagctgggctaaggaaaaggctggtggtgccttctcagcaggtcttgccttcatccttattaacttgattacaggtcacttctttggagtgacgactgacatgcttgcagatgcagcagcaaccgtaaccactgtttttggaacagagattccagtttcaggctacttcgtcaacatcttgggtcagcctgctctgaacatgggtgtcttcgttggtatcatcgctggttttgtaggggcaacaacctataacaaatactacaattaccgcaaattacctgatgttttgaccttctttaacggtaaacgctttgtaccatttgtggttatctatcgctcagttcttgtagcgctaggattagctatcttttggccagttgttcaaacaggaatcaacagctttggtaaatggattgcaagctcacaggatacagcaccaattcttgcaccttttgtttatggtaccttggaacgtttgcttcttccatttggtttgcaccacatgttgaccattccaatgaactatacatcacttggtggcacctatgacatcttgacaggtgcacaagcaggtacacaagtatttggacaagatccgctctggttggcttggattacagacttgatcaacctcaaagatgctggcgatatggctcagtacaatgaccttcttgcaaacattactccagcccgtttcaaagttggtcaaatgattggttcatcagggattttgatgggattgacttacgctatgtaccgcaatgtggatgaagataaaaaacataagtacaaaggtatgtttatttcttcagcacttgccgtattcttgacaggtgtaacagaaccaattgagtttatgttcatgtttgcagcaatgccactctatgtcgtttatgcttttgtacaaggtgcggcttttgccatggctgacattgtcaacttgcgtatgcactcatttggtaatatcgaattccttacacgtacaccgatggcgatcaaagctggtatcggtatggatgttattaactttatctgggtaacagccctctttgcggttggtatgtacttcattgccaactttatgattaagaaattcaacctagcaacagctggacgcaatggcaactatgatacagaaacaacggatgtggtttcaaactcaaacgtagatactgcggatgccaattcacaagtggttcaaatcatcaacttgcttggtggtcgtgataatatcgcagatgtggatgcttgtatgactcgtcttcgcgttagtgttaaagatgtggcacaggttggagatgaaaatgcttggaaacaggctggtgctatgggcttgattatcaaagactcaggtgttcaagcagtctacggaccaaaagcagatgttctcaaatcagacattcaagacttgctagaatctggcgtagccattcctcgtacggaaattgttgcgacagaagaagttgctcctgagactcagttcaaaggtgtgacggagacagtctactctgttgctgaagggcaagccattgccatcacagaagtgaaagatccggtcttctcacaaaaaatgatgggcgacggttatgcagttgagcctagctcaggcaatgtttacgcaccagtttcaggtattgtaaccagtgtcttcccaaccaaacacgctgtcggtattttgtctgacaagggtgtagaagttttagttcacgttggtttagacacagttgcactaaacggtgctccattctcaactaaggtaacagatggtcaacgtgttgaagcaggggatttgctccttgtcgcagatttggaagccattcgctcagcaggacgtgaaacaactatcgtcgttgccttcacaaacacagctgaaatcaaatctgtcagccttgaaaatcttggacaggtcagtcaagatagccaagttgcgacagtagagttgtaaaaagtaaaaaagattgaaaagatgattgcagtcaactcttttcaatctttttcttttggatagtatgccatcagtatttttctaatttcttcgcttcttttttacctttttcagcgatatggaggaaataaatagaccaagcaaggaaaaataagggaataatgccacttctaaacaatgcgaatggggtttcaaagagaaaaccaaaccaaaaactggtaccagttcgttcccatagtcctggagttaggtaccaggatttaggattccaaagtgtgtatccattttggagtccaacttggtaatggataaaaaataaagtcagaaataatccgaaataggagtaggcataattttggtagcgtgaatagaatgcttttttcgattcggtatcagaaaaaatttctgtgcttgaagtttcgattgtttgttgaaaataatggatgccacatctacgactaccttgtataggttgccaaccacagtcttcaaatagagagaggtaatttgaatattctccttttgcaatatgttcatgaaaatcaaggcgtacgggatgaggggttcgactacatttttcaaaatgataggttgctgtccacggagttactttgacaagctgataaccttcggattgaatcgaattgatccaatgttcttcctcttgtaaactggtgaataatttgtgtcttatcatggcttcctccttaaaaacctaattctttggcaatatgatgtagtttttgaatacgctgtgtttccagtttaataatctcttggcccgttgctgttacttgatagacttttcttcttttatcggaacttggaacagaacaaatccattttagtttcaaaagattctcaatcgctccatacatggttcctgcagcgattttcacatcaccatcactcatatcctctactttttgcatgatatggtagccatgggcaggttccaagagggctaatagaatatagtaggttgtctccgttaaggggagatgcttgttccttttcatttggtttctcctatgtagttcaaatgtatagttgtactatatattatatatcgggaaactatacatgtcaactgtatagtgaagaagattttaaaaatcttctcaatccttgccatttatggtataataaagcgattttataaaatgtaggaggttccccatgggacgtaaatgggccaatattgtagccaagaaaaccgcaaaagacggtgctaactcaaaagtttacgccaaatttggtgttgaaatctatgtagcagcgaaaaagggtgacccagatccagaaacaaactcagcgctgaaatttgttatcgaccgtgctaagcaagcgcaggttccaaaacacatcattgacaaggccattgacaaggcaaaaggaaacacagacgaaaccttcgtggaaggtcgttacgaaggctttggaccaaatggttctatgattatcgttgatactttgacatcaaacgtaaaccgtacggcagctaacgtgcgttctgcttttggtaaaaacggcggtaacatgggtgcatctggttctgtatcattcatgtttgataaaaaaggtgtggttgtctttgctggtgatgatgcagatgcgatcttcgaattgctccttgaagcagatgtcgaagtggatgacgtagaagcagaagacggcacaatcactgtctatacagctccaactgatttgcacaaggcaatcgtggcacttaaagaatcaggaatccaagagttcaacgtcactgaacttgaaatgatcccacaatcagaagtatcacttgaaggcgatgacctcgcaacatttgaaaaactctacgatgccctagaagacgacgaagacgtccaaaaaatctacacaaatgtagatgggttttaatataaaaaaagtgctagtagcactttttttatattaaaaggttggagattggaatcgtcggtagacgattctcattgtacgtgggacgtcctagaaggttggagattggaactgccgtgccggcaggcagttttctttatactcaaaagtccgggggacagtcatttttattaaaaggttggagattggaatcgtcggtagacgattctcattgtacgtgggatgtcctagaaggttggagattggaactgccgttaggcagttttctttgtatccaattgctcaaagacgatagttggttggaactagagaagtggggatattttagcttaagtttgaataaggtacgatggaaaaatttgcggagttttcggtggctgatagtagagtgcttgatagatgaggtataaggaaaaactatagccaggctttggaaatatctatttgaatggtcacgggttttctgttatcatagaacggtaataagattaggagaatgtatgtcaaataatttacttgttttacaatcagattttggtttagttgatggtgcagtttcagcgatgattggtgttgctctccaagaatcgagagatttagttgttcaccatctaactcatgatattactccgtacaatatctttgagggttcatatcgcctctttcaaacggtcgaatactggccggagggaacaacatttgtttcggttgtcgatccgggagttggttcaaaacgtaagagtgtagtagctttgaccgaacaaaatcactacattgtaacgccagataatgggacgctatccttcatcaaaaaatatgtggggataaaggcggttcgagaaatttcagaggtggccaatcgccgtgccaatacagaacattcgtacaccttccatggtcgagatgtttatgcctatacgggagctaaattggcttctggacacattagctttgaagaagttggtccagaattaagcgtggataagattgtggaaattccaacagtcccaacggaagttggttcggactatgtaaaaggtgcaattgatattctggatgttcgatttggctcgctttggacctcgattacgagggaagaattttacaccttgcaaccgcagtttgaagatcgctttgaagtgaccatatacaataacgacatgcttgtgtatcaaaaccaagtaacctatggcaagtcctttgcggatgtacgtatcggacagccattgatttatatcaattccctctatcgtgtaggtgttgcgattaatcagggctcatttgccaaggcttataatgtcggtgtaggtcaaaactggcatattgaaatcaaacgtattagtaattaaagaaattttaggagatagttatgaaaaataattcaatcaaaacagtcgttgctactggtatcggcgcagccctctttgtggttattggtcatttaatcaatattccaacctttgtcccaaatacttctatccagcttcaatacgctgttcaatcgctattggcagttgtatttggtcctgtggttggcttcttggtcggtttcattgggcacacgcttaaggattcgttgacttacggtccatggtggtcatggattttggcatcaggggtctttggtttggttgttggtcttaccaaaaaacgtctgcgtattcaagaagggatttttgaagggaaggatattcttttctttaaccttgttcagattgcggcgaatgtgcttgcttggggagtcattgccccagttttagatattcttatctatagtgaggcggcgaataaggtctttgcacagggacttgtagcaggtattgcaaacagtattacaattgctattgcagggacactccttttggttgtttatgcaaaatctcaaacgaagacaggtagtttgtctaaagattaagtttttattttccctagaaaaaattctagggttttttcaataccaaaaaatacatatatgatataataatataaaacaaacaaaaacatgtgttcaaggggagaagtatggtctggacagaagaaaagttgggaccgattattcattctatactcaatcctgacgaggaagttttaagtctttatcaatcgaaaacgacgaaatcaatttatggatgtattctttggaataattattattataaggtttttcgagttagtaaccacccatcacaatctacatataaacagccgactttttatgatttccatggcgaattttatatgaaaggagcgattcggacctacctttatcacacgaacagttggtatgaacttagtaaacaaggctattaccttcttctcttttttcaaaagttatgggatgaaaagcaagaggtggaggcgagttggcaaaatggtaggatgcagattcgcttagtggttgaagaagaggggtggcaagttcattaccgttttccagataatcaggcaagggaggttgaacgcttattgggctcaggcatgctggtggccattcgctcctccagaaattttatcaagatacggacgagtcgttttgttgcaccgtatatagctctaatcaaacagcgtcaactttatcgaaaaaagccgagtaaagctatgctccagtgggaaaaataccaaagtcaacttattgaaatccaaaggacctatcggctagtggaggaaagtgctccgcaaactttttttggacactggttgaataaggtccaactctatctctgctctgccattgccagctattgggaagaagttattaaaggagtggagtggcaggaggcaagagaaatcaaagagcaaaggaaagccgagaagccacataatcctattgaagataaatggaaggaaaatattgctagacgccataagcgaaaaatggaccaacttatcggacatgataccttggaaaaactccgacaactgaaaacagaattagacgactaagaagttatagcgaaccttcaataaatgcagtagcatgtcattcatgttaccgtatttttttacatataagcactgaacctgcgaatacaggttctaaattttcagttcagatttttgtcttttgaggggctaaacgatataatacgtaaggtatcatttattagaaatgacagagttttatcatctattgcaaagattgaaaaggagacactatgtcaaaagatattcgcgttctactctattacaagtatgttccaattgaaaatgccaaagaatatgctgctgagcatctagctttctgtaagtctatcggactaaaaggacgtattttgattgctgatgagggaatcaacggtactgtttctggtgactatgaaacaactcaaaagtacatggactacgttcatgcaaacccattgttcagcgatttgtggtttaagattgatgaagaaaatgagcaagctttcaagaaaatgtttgttcgttataaaaaagaaattgttcaccttggtttagaagacaacgactttgacaacgatattgacccactcgtgacaacaggtgcctacctatcaccaaaagagttcaaagaagctctcttggacgaagatacagttgttttggatacacgcaatgactatgagtatgaccttggtcacttccgtggtgcgatccgtccagacatccgcaacttccgtgagttgccacaatgggtccgtgataacaaagagaaattcatggacaagcgcgtagttgtttattgtactggtggtgttcgctgtgaaaaattctcaggctggatggttcgtgaaggctacaaggatgtcggtcagctccacggtggtatcgcaacctatggtaaagacccagaagttcgtggtgaattgtgggatgggaagatgtatgtctttgacgagcgtatcgcggtcgatgttaaccatgttaacccagttgtcgttggtaaggactggttcgatggcacaccatgtgagcgctatgtcaactgtggcaatccattctgtaaccgtcgtattttgacatcagaagagaatgagcacaagtatgttcgtggctgttcagctgaatgccgtgctcatgagcgcaaccgttacatctctgaaaacggcttgactcgtcaagaatgggcagaacgcttggaagcgattggggaaactcttactccagcaaatgcttagtaataccaaaattgcattgaaaaatcagtgcaatttttttgtgcaatcagaattctttatattttttcagtccattctatacgaagcctatcaattagaaaagagaaggagatgaagtcattttggatgaacttatccccttcgaaaatcaacattatccgttgtcaacttgccttgatgaacttcagttctatcttcggcttcgtttcctcggtcacttttgattttcattgagtattagcagtagcagaccttgaatagctggtcggttttatgaagcaatcggttttgcagttgcgacgtttggagatattaagtctgcgactttgcctaagggtggcaacttgattttgatgcaggcagatagctttgctcaacgcgtaccatttcaggtagtagcgagtggcaatgaagtcttgatttcgcttaatgtggcgagtagggaagaagtagatagaattatcgagcgtgttgaagcaaatggcgggcaaattacaggatgcccgacagatgcccgtggcttttatggagcaagttttacggaccttgatggtatcattttaatgtgattgtgatgtaggaagttagaattcatctgctctagaatcatagatgaacttatttgaaaagggagaaactgatgattcttcctttttttcagagtcaatttacgctataatagtcctatgaaaaaaatcattgagtttaaagattttacatttaaataccaagcgcaacaggaacccactttaaaagatattcagttaacgatttatcagggagagaaagttctgattattggcccatctggttcaggaaagtcgacgattggacaatgtcttaatggtattattcccaatatttacaagggagaacatagcggaagtttactattggatggtcaggaagcatttaatctttcagtttatgataagtccttgctcgtatcaacggttctccaagatacagatggtcaattcattggcttatcagttgccgaggacctagcttttgctttggaaaacgacatggaaagccaggtggtgatgaagcaaaaagtaggagattgggcagaaagactgtctttgaccgatttgctggcacatcgaccacaagatttatctggaggtcaaaagcaacgtgtcagtctgggcggagttcttattgatgagagtcctattttgttgtttgatgagccacttgctaatttagaccccaaatcgggccaagatacgattgatttgattgaccgtctgcacaagcaagaagggaccacaaccattattatcgaacaccgtttagaggacgtactgtatcgtcaggtggaccgagttgtattgattaatgatggtcggattttgttcaatggaggaccggatgatttattacgtacctcattgttacaggaaaacggcatccgtgaacccttatatctatcgactcttcgcgccttaggatatccgattgcgcaggcagaacgcctctcttcagtttgggaaattgatattgaggctttgaatatagcatccctaccgactctacactttgaaaatggagagaaagaggctttgttagaagtcaagcatctttatttttcctatcctaacaaacaagttcttacagacattcaactgacgattcataagggggaacgtctagctattgttggaaaaaatggtgctgggaaatctactttagcaaaggtgctttgtggttttattcagggtgagggtgagattctctggaaggggcagtcaatcaaagaagattctgtcaaagagcgagcagaacggattggttatgttcttcagaatcccaaccaaatgattagccaaacgatgatctttgatgaggttgctcttggtttgcgcatgcgaggggtgacagaagaagaaattgaacaccgagttcaccatatcttgaaagtatgtggcctgtatccgtttcgtaattggccgatttcggcactttcctatgggcagaaaaaacgggtaacgatagcatctatcttggttctcaatccagaaattattttgctagatgagccaacagcaggacaagatcaacgacattatcgggaaatgatggagtttttggatcaattaaatgctcaagggcacaccattgtcatgattacccatgacatgcaactcatgctagattattcagatagagctgttgttgtggtggatgggcagattattgaagatgccagtccagcagaaattttatctgatgatacggtgattgagcgagccaatttaaaagaaacatcaatttttcacttggcggagagggtgggagttaatcccttagaattaacgacgttttatatgcaggaagaaaggagaggaagatgagtcaacaaaaactaattggttaccatccaggaactggcttgattcatagtttatcggctgtcagtaaattactcttttttctcatagtttccattcttgctatgattacttacgatacccgcttgattctttttatcgcagtattttctctagccttgtttaaaatgtcagggattcgttataaagaaatctctcttgttttaattctgacaatcatttttgctgcaatgaatgccctgatggttcacttgtttgcaccacggtatggagtggaactttacggagcagacactcccttgctatcaggtctgggagtttattccttgacgagtcagcaagcattttatctggtgaatcttctcttgaagtatttttgtacagttcctttagcgattatctttctcatgaccactcatcctagccagtttgcttccagcttgaatcaaattggggtatcctacaaagttgcttacgccgtcagtttgaccatgcgttatattccagatattcaagaagagttttatacgattcgaatgtctcaagaagcgcgtggtttggaattgtctaagaaaggaaaattgatggatcgtataaaagggaatctatcccttgtcattcctctgattttcagctccttggagaggattgatacgatttcaacggctatggaattgcgacgttttggaaaaaataaaaaaagaacatggtatacccaacagcctctacagagaatagattacgctgtcttgctatttattcttgctctagtagtggtgacaatctatctattttttgttaatcaggggcgattctataatccgtggcgatgattattgagtttattggacttatcaaccctttatcgttgacatataggaaatatactgttacagtagggaatgtaaataaatttagagtttaagtatcagtttcatcttttgtttttcctcttgataagttttacaaataaataaaaagaggtaacacaaatggtacaaggtacagttaaatggtttaatgcagaaaagggatttggttttattgctcaagaaaacggtccagatgtatttgcacacttttctgaaattcagtctaatggtttcaaatcgttggaagatggtcaaaaagtgacatttgaagtggagcaaggccaacgtggtcttcaagcaaccaatattacaaaaattggataataaaagagcgggtttcttagtgaaactcgctcttcttatgtttaaaggggtcttttatttggcataccagctttgcgtggaaacttatttggagtttcctttttcttttcgacgatggtcaatgttcgagggtcgccatttggaagagtatagtcgtggttttcgatgacttttgcgaagaggagattgagtgcgttttttgcttgggtcaattcatcttctgcgctggacgccttaagtgcgattaattttccgtggagcttcaaataaggaatagtcaattcagaaagaatctgcatgcgggcaactgcgcgtgctgtgacaaggtcaaattgtgcacggaagttcttatcttgtgcaaagtcttctgcacgaccatgatagaaatgaacaccttcaagctctagttcttcggcaagcaaatgtaaaaagttaattcgtttattaagagaatcaatgatggtaacatctagttgcggaaagatgatcttcataggtaggctaggaaatccagctccagctccaatatctaaaagccgaagaggttcgttctgaatatggccttgcaggagtggagcgatagaatcgtagaaatgcttcagatagacttcgctttcctcggtaatagctgtcagattgattttttcattccattccactaatagttggaaatagcgatgaaattggtgtttttgttggtcagttaattgaataccttggtctgccaaggttttataaaatacttcaggtttcataatcttatcttatcataatttaagcaaaagaaaaacccagaagagtctgggaattttcttattgaccatctgtctgtcccgttgcgggattgtttcctgttgttgcagtttcagttgaagaagttgcagtctcggttgcagttccagatgatgtttcgcttgatgttgtcgtcgcttcggttgtttcactagtttcagtcgaactagaagaacttgtactagagctagtgtaagtattataagcattggagagtgagcgactacctctgagatagtagttggaaccgtaacgtacgagtccgcttggcatctcccaatcggtagctgtatagtccgaatgcataaagagcatcatattgtggtagacatctgttgcaattcgcatgctgttatcaaggataggagtcatacgattggtatatccggtccaaacagccattgcgtactgactagaatatccaacgaagttttcatcaggaacgaccatgtagctataatttgcttctggaattgaagctagaatagtatccgtttcgctatcggtatagtttgatgtacctgttttaccggccataggaacaccactaacagaagcgtttaatccataaccgtaagacataacagccttcatcatgtcggtcatcatgtaggctgtttcggcagacatgactttggtccctttaggagcatattctgttactgttccatcactaaagacaattttattgacatactgtggagcgtagtaagtaccaccattggcaaaagcagcgtaggcagcagccattttttcactacttgctccatacttactgctagtatcggatgtattacttgaaatagcattagagtaatgaatatctggataattgataccaacgctattcaaaaatttcaaggcattttctaagcccgtagcttccaatgctttaacggcggtaacatttcgagaatactgaatggcagtcttaacagagatattaccgtagtattgtttatcccagttattgacaggagttggtgtaccaggatagttataaggaccgtctaagattaaatctgctgtagatgtataaatgccgttttcaaaagcaggagcatagtctgtgattggcttcattgtagaaccgaagtcacggttggtttcaacggcttggttggtaccaaatgagacgtttgtttcttgtttacgaccccctaattgcgcaacgactttaccattagaaacatccacaaccgttgaagctacctgcaataaatcatctggatagctgacatacatatctgtattgtagatattccaaagttgctgctgggcggcaggatcgacgttcgtatagacatccatccctgttgtcagcaagttgtaacctgtttttgcttcaacttcttcaacgacttgtttcagatagttgtccatataagcaggataagcagctgcattagatagtggttgcaaaccatctgttacaggtgttagaacagcttgttcatactgggtattatcaatgtacttttcttccagcatctcagccaataccaaatcgcgacgtgcttttgcatcttctggattggtataaggatcatattggtttggcgcttggggcattcctgctaaaagagctaattgaggaagagtcaaatcttttaactcttttccataaaaagcaagagcagcagtcttcataccgtaattaccgtttgacatatacaccttgttgatgtagtaggtcaaaatctcttgtttggtattgcgacgttccaattgagtagctagccaagcctcttgaattttccgttttagattttgatcttctacggatgtcgagaaataagtcagcttgataaactgctggtcaagtgtcgagccaccctgcaaacgtcctccgctcaagttattaatcagggaacctgcaatacgaatcacgtcaactcctctatgattgaagaaacgttggtcttcgattgcgacaatcgcatttaccaagtctgttggaatttcttcagtcttggcactcgaacgtttttctgctcctaaatctgcaataagatttccgttcttatcataaattttacttgacacagttgctgtcaaagattcttctgtcaattctggagcgctttggatgtagtaaacaaccaatgcagctccggccaggcaggcaatgatagcccccgcaagtaaaatatttgcagtgattagaagagcttttttaattgttgtagttttcaaaagattcaccacctaatagatttttttcaacgatttccagatatgggatgctggggaaacgccccatttgaatctcaaagccgtattgtcgaataaaggttagaggcatcgacttactacccatgtctacttgataaaattcgatcaaatgagtggctggcaagagataggtttcttttaatgttgaaaagtgaagaaggacaaaacaaataccaccttgtttaacaacctgtttcatgtgttcaatctgatgcgcatgaaaatttttcatgggcatggatgctttttggcgtgtctctttcgcttcaaaatcaatataatgtcttttaaaaacaccagagtagtctgtggtagatgcctgtcgaaagtatgcttcgacaatcttagcacggctccgtttggggtaatcaacttttacaatttgcacgggagttggcttcttgtgaatgacagcaatatcgtgcgcaaggtaatattgattgctatcgttgatagcggcctcaaaagacattccgcgattagcaaagtttactcgctgggatgaaataggactggttctattgattttttttgacaccttatgaggataattgaccatagaactccttcttgataaaataatatcagcatattataccataattagcgaaaagagtacaagaaatggatactaagagccttttggtaacaggttatagacatacagacctgggaattttttcagaaaaagatcctcgactgcacattattaaatctgcaattcgtaggaattttattcgttttttagaagagggtgttagttggtttatactgacaggtcaattgggttttgaatactggtccttagaagtcttagaagatttgcgagccgaggggtatcaactgagtattgcaacaatatttccatttgaaaatcatggcgaacagtggaatgaggctaaccaagcaaagttagcacggtttaagcaggttgattttgtaaagtatgcctatccacgctatgaaaacccagggcaatttagagactataaccagtttttactggataatacgacaggttgttatttgttttacgattctgaaaatgaaaccaatttgaaatatttatatcacatggtcttaaagaaagaaggatataatagaaaaacgcttacctttgaggaattgaatgaggaggctgaaaatttttcaaattctgagtgatttgacttgatttttccctattttttttaatataataggagtagtgacgttttagattagggagagagagatggcaagtattaaatttacgacaaaagatattttcgagcaagattttaaaattggttttcgtggctatgatcaagatgaagtgaacgattttcttgatgatattatgaaagactatgatgcttatgaagcgattatcaaggaattaaaaggcgaaattgctcgattgaaagcgcaggcagcaaattctcccaaaacaactcttcctactgaagaatcgaacgatgtattgcgtacagaacgtccatcttcagcgacaaactttgatattctccgccgtctgaatcgtctggagaaagaagtatttggaaaacaaatcgttcaggatcaagaatagaaaattgtacacctaaactgacactttattcgcagttattttcttgtgcacaaatacattctgtatttgtgtcagagatattccttgatttaaagtggcttgctttgtagatacaacttctaagataattaaggtgcaatttttggataatcgcgtggtagttttctaccatgaggaaagtccatgctagcactggctgagatgccagtagtgtttgtgctaggcgaatcaataagcctagggacgcccttgggcgttacggcggttaaaatggctaagtcttttgatatgtcagagtagatctgaaagtgccacagtgacgaagtttttatggaaacgtaaaaaatggaacgcggtaaacccctcaagctagcaacccaaactttggtcggggcatgggatggatggaaatgaacagaaatcctgactgtttagacagtagacagatgattatcgaaggtggtagaacctagtaccactggaacaaaacatggcttacagaaaattgcataaaataggtagctagctctgctagcttttattgtagaggaaaaaaatgaaaaaacaatttgagttgattgcaacggcagcagctggtctggaagcggttgtgggtcgagaaattcgtaatctcggctatgaatgccaagtggaaaatggccgtgttagattccaaggagatgtaaaatccattatcgaaaccaatatctggctgcgttcagcagatagaattaaaatcattgttggacaatttccagcaaagacttttgaagagttgttccaaggagtttttaacttggattgggaaaattacttgcctctaggctgcaagttccccatttccaaggccaaatgtgtcaaatcgaaattgcataatgaaccaagtgtgcaggctatttctaagaaagcagttgtaaagaaactgcagaaacacttctctcgtcccgaaggggttcccttgcaagagatgggggcagagtttaaaattgaagtgtcgattttgaaagatgtggcgacagtcatgattgatacgacaggttctagtttgttcaaacgtggttatcgggtggaaaaaggtggcgcaccaatcaaagaaaatatggcagctgctattttgcaattatcgaattggtatccagataaaccgcttattgaccctacttgcggatcgggaactttctgtattgaggcagctatgttggctaaaaatatagccccaggtttgaagagaagttttgcatttgaggaatggccgtgggttgaggatcaattggtggttgcattacgcaaagaagcacaagcttctatcaaaacagatttggtattagatattactggatcagatattgatgctcgtatgattgaaattgcgaagaagaatgcatttgcggcaggagttgagcaggatattgttttcaagcaaatgcgtgtgcaagacttgcgtacagataaaattaatggtgtcattatttctaatccaccttacggagaacgtttgttggatgatgaagccattgttaccctgtatcgagaaatgggggagacttttgaaccactcaaaacatggtctaagtttattctaactagtgatgagttgtttgaaacccgttttggacagcaagcggataagaagcgcaaactgtataatgggaccctaaaagtggatctttatcaattttttggtcaacgagtgaaacgtcaagtgcaagaagtgcaaggataggaggacatcgtgggagaaaaaaatagtcatcatcttcctttggatgaggagaaagttttagattttgaagtggcgaaagatttaacaatcgaagaagcagtcaaaaaacataaggagattgaagcgggtgtgacagaagatgatggtctcttggatcgttacatcaagcaacaccgcgcagaaattgaatctcaaaaatttgaaaccaaaatcaatcatcttcctttagttgaggtggctgatgaggaaaaaaatcaaggacatgaaagcgcggaagaggtagaagcaaatgagtcttctcttacggaagttagtgaggagattgctcctattgtagaagaactttcggtaactccgatggaaaccttggaagaaacagtgattgcaagtaccgtagcaatggaggggttatcttcagtggcagatgattctagtttagaattggaagaagatgaaaccgaagacttggaccatagtgagggcgcagatagggatcagaaaaagaaattttacttctggtcagcagtagggctttcaatgattggtgtaatggcgacggcgctggtttggatgaattcggttaacaaatcgaatactgcgacttcttcaagttcaacaagtacaagccagacgtcatcaacagcatcaagttcgacagatgcgaatgtgacagcttttgaacagctctataatagtttctttacggatagtagtttgaccaagctaaaaaattcagagtttggtaaattagcagaactgaaagtgctgttggaaaaattggataagaattcggacagttataccaaagctaaagaacagtatgatcatcttgaaaaagccattgcagccattcaggccattaatggtcagtttgataaagaagtcgttgttaatggtgaaattgatacaacggcgacggttaaatcaggagaatctctttctgcgacaacgacagggattagtgcggttgacagtctattggcatcggtcgtgaattttggtcgttcacaacaggaagtcgcttcggctacggtagcaagtgaggctgcagttacaagaaaccaaggtgctgatgaaactgtatctactggtgtaccagcgacaacagaagtcgcttcaacaacggtttcaggctcaacaaccgactttggtattgccgtgccagctggtgtcgtcttgcaacgtgaccgcagtcgtgttccttataatcaagcgatgattgatgatgtaaacaatgaagcatggaatttcaatccaggtattcttgaaaatattgtgactatctcgcaacaacgtgggtatataacaggcaatcaatatatcttggaaaaagttaatattatcaacggcaatggctactacaatatgtttaaaccagatgggacctacttgttctctataaattgtaagacaggctactttgtcggtaatggtgctggtcattctgatgccttggattattaaacaaaaaagcggtttatctgcttcggattgaagaaaaagttcattttggacaatttccttcaatcttttttctttgtgttgaaaatatagtcatttgaattaactttgatacatcgtcactttcggcttgccgtactctgcagaagtgacttgctttgcaagttatatctccaacctagcacagccactaggctgtgctagcaacctgcacctcggttccttgtctgaaagctaattcattcgactataaaaaaactctcagaaacgccgaaatatcaatgtttctaagagtttaatgatttgctatctttcgcaaacttcttcaattttatatatttttaggagtttgtctacgttctgagcggtgtatccgctttttttgttagattggttttctttcaaaggcatctgtagagattccctgagaaaggattagtttggcccattctttagctgaatgaaggctgtggtctttgtagttaccacatgattcaatggttgtcccaggaacatcctcccaagtgatgccttctgcaatttcttccaaactcgacttgatgacttgagcaatcttttcagagtcttgttttccccacataatcatgtggaaacctgtccgacacccgaaaggagagcagtcgattagcccatcgatgcgctggcgaattagtttagctaatagatgctcgatggtatgtagaccagctgtatccattgcattttcgttgggttggataaggcgaatatcaaagtttgtaataatgtctccttttggtccgacttcttcagaaattaagcggatgtaaggtgcttttacaatagtgtggtctagctcgaagctttcgacagtgacttcttttttcatggtttcctccaaataagtgatgaatttattataccatatttgacaatttggaattgtgaaatcgtttcaaatatgataaaatagatacagattttgtgaaaatcgaattataaaaaaagaggtagaaatatgaatatcattacagtagtagtgacacttgtttctgctctcattggtttagtattaggttactttgccatttctttgaagatgaaatctgcaaaagaaactgcagaattgacacttttaaacgcagaacaagaagctagtaatgttcgtggtcgagcagaagagcaagctgaggttattctaaaaacagctgagcgcgatcgccagaccttgaaaaaagaattactcttggaagctaaggaagaagctcgtaagtaccgagaagaaattgcagaagaatttaagtcagaacgtcaagagttgaagcaaatcgaatcacgcttgacagagcgtgcgaccagtttggaccgcaaagacgataatttgaccaacaaggaaaagactttggaacaaaaggaacaaagtctgaccgataaagctaagcacattgatgagcgtgaacaagaagttgtaaaactcgaagaacaaaaagctttggagttagaacgagtggcggccctcagtcaagaagaggcgaaggaaatcatccttaccgatacacgtgataaactgacgcatgaaattgcgactcgtatcaaggaagcagagcgtgaagtaaaagaacgttctgacaagatggcaaaggacttgttagcccaagcgatgcaacgcatatcaggtgaatatgtggctgagcagacgattacatcggttcatttaccggatgatgcgatgaagggacggattattggacgtgagggtcgaaatattcgtacctttgaaagtctcacaggtatcgatgttatcattgatgatacaccagaagtggttgttctatcaggttttgatccgattcgccgtgagattgcccgtatgaccatggagaccttgcttcaagatggtcgtattcatccagctcgtattgaggagttggttgagaaacatcgtgtagagatggataaccgtattcgtgagtacggggaagctgctgcttatgaagttggggcaccaaaccttcatccagacttgattaaaatcatggggcgtttgcatttccgtacctcttatggacaaaatgttcttcgccactcaatcgaagttgctaaattagcaggtgtacttgctgctgaattgggcgagaatgtgaatttggcacgtcgagctggtttcctacatgacgttggtaaagctattgaccgtgaggtggatggaagccacgttgaaatcggtacagaattagctaagaaatataaagagaatccaattgttatcaatgcgattgctagtcaccatggcgatgtagaagcaacaagtactattgcagtcattgtggctgcggcagatgctctgagcgctgctcgtccaggttcacgtcgtgaatctatggaagcctacatcaaacgtctgcaagacttggaagaaatcgccaacagttttgaagggattaaacaatcctatgctattcaggctggtcgtgaaattcggattatcgttcatcctaacaaggtcactgatgatcagattaccatcttggcccatgatgttcgtgagaaaattgaaaataatctggattatccaggaaatatcaaaatcacagttatccgtgaaacaagagcaacagatgttgctaagtaaatgtagaagagtccgaagggctctttttctactggctcaaagttcgttttgggttgggaatagaaaatagaaaatattttaatcgtatttaaaagcagttgaaattcatgctaaattttgttacactagaatgaaagatttaaaaggagatatcatgaaagagcgaggcttactcattgtcttttctggtccatctggtgttggaaaaggaacagttcgaaaggaaatttttgaaagctctgataataaatttgaatattctgtatccatgacgacacgtccacagagaccgggagaagttgatggagttgactatttcttccgtagtcgtgaggaatttgaagatttgattcgccagggtcaaatgttggaatatgcagagtacgttggaaattactatggaacacctctgacctatgtcaatgaaactcttgataagggaattgatgtctttttagaaattgaagtacagggtgccctccaagtgaagaaaaaggttccagatggggtgttcattttcttgacaccacctgacttggaggagttgcaagatcgcttgattggtcgcggaacggatagtgaggaagttattgctcaacgtatcgaacgtgccaaggaagagattgccttgatgcgtgagtatgattatgcagttgtgaacgatgaagttccgttggctgctgagcgtgtcaagcgtataatcgaagcagaacatttccgtgtagaccgagtgattggtcgctacgatgaaatgattcgtgaacagatagtagaacgataaaagaaagaagagagaatcgcattatgatgttgaagccgtcaattgataccttgttggataaggtaccatctaagtattctttggttattcttgaggctaagcgtgcccatgaattggaagcaggtgccaaaccaactcaagaattcacctcagtgaaatccaccctacgcgccttggaagaaattgaatcaggtaatgtagtcatccatccagacccagaagcgaaacgtgaggctgttcgtcgccgtgccgaagaggctaaacgtttggcggaagaagaagagcgtaaaatcaaagctcaaattgctaaagaaaaagaagaaggcgaaaagatttagatacaagactcggttgggattgccatccgggtttcttttcactttcggaatgatgaaagttttgacagaaaggaggcaggtcatttagtttatcttttaatatttgctccaactaatagttgaaggttatacataaagtgaaccttgttcgcatcagtcgtgatattagaaggtaaaataaatcgagatggtatgttagcacagattattgtagatgtccctttgatgcagacagatcaagcttattcctatcgagttccagctgagttggaagaggggctcaaggttggcgtgcgtgtccatgtaccctttggtaagggaaatcggctgattcaagggattgtagttgatttgattgatgaagatgatgaaaatagcttacaagacttgaaagagcttgccgaggttttggactatagtcctgttctcaatcaagagcaattttggttggcggaccagatgagaaagtcggtcttctcctataaaattactctcttaaaatccatgctacccagcttgctcaattcgacctatgacaaattgatccgtccagggattggtttggaaatggcagagcagattagtctgtttggtgataaggagcagattcgtttttctgacttggacgtgacagagcaagggaaaatcatgcgtctggcccagtcaggaaaaatcttggtagactatgtggccaaggataagaagcaaatcaagacagaaaaatggtaccgagtttgtctggagaaattacgagaagcagacatcagcaatcgggctaaaaaacggcagcagttaagggaatttcttctggaacagtcggaagaccagctcctttcaaacctaaaatcggactattcagctgatacgctccgctatttccaagaaaaaggctatatagaagtctgggaagaggaagtgtcgcggactcagggtgtttttgataaggtagaaaaaacgcaggccttggatttgaatccagagcaggccattgcggttcgggagattgtagcctctatcggtcaggaaagtcagacatttctactgcaaggagtgacaggttctgggaagacggaagtctatctccaggttattgatagggtcttgaagatggggaaaacggctattatgctggtgcctgaaatttccttgacccctcagatgaccaatcgttttatttctcgttttggtcagcaggtcgcgattcttcactccggtctgtctgatggagagaagtatgatgagtggcggaagattgaggcggggaatgcccaggtggttgtcggggcccgttcggccatttttgcccctttgacaaacttgggtgttatcatcattgatgaggagcatgaagcgacctacaagcaggacagcaatccacgctaccatgcgcgtgatgtggcaaagttgcgggcagactataatcgagcgaccctggtcttggggtctgctacgccgagtcttgaaacacgggctcgggctagtcgaggagtctatggaagactgactcttaaccagagggccaatcccttggctcgtattccagaagtggaagttgtggatttccgtgattatatcggtcagcaggaggctagtaattttacccctgttctgattgaaaagataagagaaaaattggctcgtaaggaacaggtcgttcttatgttgaataggcgtggttattcttcttttgtcatgtgtcgtgattgtgggagtgttgaccagtgtcccaattgtgatatttccctaacgcttcacatggatacaaaaacgatgaattgccattattgtggttttcaaaaggggattcctcagacctgtccaaactgtcaaagtcgttctattcgttattatgggacgggtacgcaaaaggcctacgatgaattgcaggagctcttgccagaagctagaattttgcgtatggatgtggatactaccaagaaaaaaggtgctcatgaggacttgctcgaacggtttggtcgaggcgaagcggatattcttctgggaactcagatgattgccaagggcttggattttccaaatgtgaccctagttggggtgctcaatgcggatacggctctgaatttgcctgattttcggtcttctgagcggaccttccagttgctaactcaggtagctggtcgggctggtcgagctgataaggaaggagaggtcctgatccagacctataaccccaatcattatgccattgcttttgccaaagagcaggactatgaaggtttctatcgttatgagatggacattcggaaaaatcttggctatccaccttactattttacggtgggtctaaccttttcgcacaagtcagaagaatttgtcgtgaaaaaagcctatgaaactgtagcctttctccgtcaacacttaacagatgcaattcaaatcttgggaccgacgcccaagcctattgccagaactcataatctctaccactaccagatcatcttgaaataccggcatgaagaccgtttggaagaggtattgaatcagattttggattggacacaggagagagaaaatcaagatttgcgactgattattgacaatgaaccgcagaatatgatgtgaggtcactattgaccttgcatttttttgttttaagaacctttgattaaggaaaaaataagcaaaaatgatataattaggggatagtataattgatatgaatcagaaaatgaaaaggagatgagaacacgaatatgacaaagttgatttttatgggaacgccagcgttttcagcgacggtcttaagagggctcttagctgatgggaattataacatactggcagttgtaacccagccagaccgagctgttggacgaaaaaaagtcatccaaatgacacctgtgaaagaagtagccttggaatacaatttaccagtctatcaaccagagaagctatctggaagtcaagaaatggatgagctgatgaatttaggagcagatgggattgtgacggcagcttttgggcaattcctaccaaccaaattattgaactcagttgactttgcggtcaatgttcatgcttctcttcttcctaaataccgtggcggtgcccctatccattacgctttgattaacggtgatgaacgtgccggtgtaaccatcatggaaatggtcaaggaaatggatgccggtgacatgatttccagcgatagcattgctattgaagaaagcgacaatgtcggcaccttgtttgaaaagttggctgttgttggtcgagatttattattacaaaccttaccagcctatattgctggtgacttgaaaccagtcgctcaaaatccagaacaggtaaccttctcaccaaatatccagccagaagaagaggtactggattggaataagacagctcgtcaactatttaatcagattcgcggtatgtacccgtggcccgttgcccacacctattggcaaggcgaacggtttaaaattcaagaagctgtagaagcagaaggtgaaggatcagttggtcgggttattgctcgaagcaagaaagaattgatcattgcgacaggtcagggagccctttctctgaaaactgtccagccagctggtaagccaaaaatgaccattgcagactttttaaatggtgcaggtcgagatattgcagtaggagatcaatttggtgatcaataaacatgaaacagcaagaagtctagccttatctgtattggaacaagtctttgatcaaggtgcttactcgaacatcgctctcaataaggctctagaatcttctcgtttatcagcacaggacaagggcttggcgaccgaattggtttatgggacggtttctcgtaaaattaccctagagtggtatttggcacattttatcgaagatagggaaaagttggacacttgggtctactatctcctcatgttgagcctctaccagttggtatatttggacaaattgcctacccacgcagttgtcaatgaggcagttaatattgccaagcgaaagcctggaactgacaaatttgttaatgccattttgcgtaagcttagtcaggattccttgccgaaaccagcagatattaaaagaaagaacaaacgtctatccgttcagtattctgtgccagtttggttggtccaaaccctgattgcagaatatggcgatgaacgtgcagagaagattttccaaagtttacatgatcggaataaggccagtgtacgtgtgacagatggtcaacaagtggagcgattggcagaggagctaggcgctcaacactcgcagttatcaccagttgggttggttaagcctcatggacactttgcggggacagattatttcaaggaaggactcatcactattcaagatgaaaccagtcaattggtagctccgactttggatattcaaggagatgaaatcatcttggatgcctgtgcggctccgggtggaaagacctgtcatatggcaagctatcttacggatggaaaagtttatgcgttggatttatatgatcataaactaaacctgattgaagaaaacgcacgtcgtttaggcctagcagataagattgagaccaaaggtctggacgccagtcgtgttcatgaggaatttggtccagatacctttgataaaatcctagtggatgccccttgttcaggtattggactcatccgccgtaagccagatattcgttataataaggcatcgatggattttgattctctaaagactatccagttgcagatactggacagtgtttgccaaagcttgaaaattggtggtataataacctatagcacatgtacgattattgctaaggaaaaccaagaggttattcaagaatttctgcaaaaccatcccaattttgaacaggtgacactagaacaccctcaaacagatattatggtggatggttgcttgttgataacccctgaacagtataagacagatggctttttcatcggtcaacttagacgaaaatcctagaataagaggaggaagttgcttagcaacgataaaaattatggaaattgcattacttactgatgtaggacagaaacgttcgaacaaccaagactatatcaatcgctacaaaaaccgcgcagggattgatttggtcgtgttagctgatggaatgggtggtcaccgtgccggccatattgctagtgagatggcagcaacagatttgggagctgcttgggttgatactcaattagtgactttgaatgatgtccgtgaatggatggttgcaatcattgatgctgaaaaccaaaagattcatgaacttggacagacagaagaatacaaggggatgggaacaactcttgaggcagttgttgtcatcgacaatcaaatgatctatgcccatgttggagattcacgagttggattgattagagatggcgaatatacacgtctaactaacgaccattcgctggtaggtgcccttgttcgagctggtcagctcacagaagaagaagcacagcgtcatcctcaaaaaaatattgtaacgcagtccattggacaagccgaaccaattgaaccagacattgctttgaaaactcttgaggttggagattatgtccttattaacagcgatggcttaaccaatatgataccaaccgaggacattcgtgatattgtattgagtgatgtttcaattgaaagcaaggtagaaacacttgtacgttttgccaataatgcaggcggtctagataatattacagtaggtttgcttcacattacggaggaggctaggtaatgattcaaatcggtaagatctttgccggtcggtatcgaatcgttcggcaaattggtcgaggcggtatggcagatgtttacctagcaagagatttgattttagatggagaagaggttgctgttaaagttcttcggaccaactatcagacagatcaaattgctatccagcgttttcaacgtgaagcgcgtgccatggcagaacttgaccatcccaatatcgttcgtatttcggacatcggtgaagaagatggtcaacagtatctggctatggaatatgtcaatggcctcgatttaaaacgttatataaaagaaaatgcaccactttccaacgatgttgcggtgcgaattatgggacagattctccttgctatgcgcatggcgcacacgagaggaattgtccatcgagatttgaaacctcagaacgtccttttgacttccaatggagtcgctaaagtaacagactttggtattgcagttgcctttgctgaaacgagtttgacacaaaccaactccatgttgggttctgttcactatctttcacctgagcaggcgcgtggttcgaaagcgaccattcaaagtgatatttatgcgatgggaatcatcctttttgaaatgttgacgggtcgcattccctatgatggagacagtgctgtgacgatcgctcttcagcatttccaaaaacctctcccatctgttagagaagagaatgccaacgtacctcaggccttagaaaatgttgtactaaaagcaacggcaaaaaaattaaacgagcgctataagtcggttgcagaaatgtatgcagatttagcttcggctctatccatggatcgtcagaatgaacccagggttgaactagaagggaacaaggttgatacaaaaaccttgccgaaactctcccaagccaatgttgaaacgaaagtaccgcatacaaacagttctgctcaagtttctgcgacggataaggggtctggtaagaaagaagtggcgaagtcgggaaataagcctgtttcaaaaccaaggccaggcatacgtacacgctacaaagtcttgataggagctattttgttaacagtcatagcggctggactcatgtttttcaacactccacgaacagttacagtccctgatgtatctggtcaaaccgttgaaaaagctacagaaatgattgaagtggcaggattggaagttggaaatatcacagaagaagcgacagcgactgtagatgaaggcttggtaatacggacctctccggctgcaaagacgaccagacgtcaagggagtaagattgatattgtagtagcaacggctgcgctggcatctattccagatgtggtggataaggagtctgatactgcgcggcaggaattggaggcccttggtttccaagtgacaataaaagaagaatatagcgaaaaagttgcccaaggactcgttatcaaaacagatccaggagcaaatagttctgctgagaagggtgcaaaaattaccctttacgtttccaaaggagtggcgccacaagttgttccaaacgttgttggaaaaagtcaggagaatgctactcaaattcttcagacagcaggcttcagcattggaaccattactcaggaatatagctcatctgttactgcaggtcaggttatcagcacagatcccgttgccaatacagagttggcaaaaggttctatcatcaatctagttatttcaaaaggaaaagaattgattatgcctgatttaacatctggcaattacacctattcacaggcgcgtagtcaattacaagccttgggtgtcaatgcggaaagtattgaaaaacaagaagatagaagctattattcaacgacaagtgacatcgtcattggacaatatcctgctgctggagcaacaattgatggaacagttaccttgtatgtctctgttgcatcaaccagaaccagtagcgattcttcagcaggaagttccacaagtacaagtacttcaacaggtagcggacaataaagatgaataaggttggggagatacccaatgtcattaagttatctaacctatcacattttgtgatgggttagtttttttatgttacactaaaaataaaaggggaaaagtcatgctagatcaaattaaagctcatttatactcttcgaaaatcaaaattatccgttgtcaacttgccttgatgaactccagttctatcttcgacttcgtttcctaggctacttttgattttcattgagtattacttgatagtatagacaatatttagttttatagccctttagtttctctttgattacttcatcaacttgctttgaactaaaagtaaactaaaactatatatcagtcagtcctatatttcctactttggatggagttcttttacttattttttgttacaatagtatagaaaggatggagaagatgcggaaagttcaattttttctactaatagaaagtatgatttttacgatggcagcctttgatgtggtagccaatgaggccagtcggaccctgctacttttctctgccttattactcgtcatttggtacttcctaggaagaaaagtcaacagtgttttactggtcagctccttatctctattatttttggtctttgttttaaatcccttcttcattattgggattatgctactagtcgtgtacatgctgattaatttcttttcacgttatgaaaagagaaatcaatatacccacattgtttttagtgactattctctacaggttcaaaaagagaaaaatagatggtttggcaaccacgaccactctcaagataggtttggttttgaagatattaacattgtacgcttgtttggcaatgatgtagttgatttggataagactgtattagttggcagagataatattgttgtaattcgtaaaacgtttggacggacaaaaattattgttccaattgatgttgaggttgcactttcagcaactagtatctatggacgagtaagtttcctgggtgaatcatattgggatttgcggaatgaaagtatagcggtcaatagtcccgattatcaagaatcacacaaacgtgtaaaagtcgttaccaacaatatactgggagatgtggaggtggttcgcgtatgagaaaacgtacctacctactcctcgcctggtttgcctgtcttattgtttttgtggtgattgcttccaccctcccacttttaaattattcattgctagatgttacgctctggatttcaacggagcagctcgtgtttactctcattctactagttattgttttgaccctttttctagctgtaatggtacaaactgtcagcctagcctccactcaggttatgcggacgaagttacaagctatcttgaagaataaaagtattcgaacagataccgaaagtgatcagctcttgctccagttgtctgataaggtcagaaacctcacgcgtcaggtgcagctggttgacaatcaagatttagtcaagaaagaagagattgttgagggagaacggaaacggattgccagggatttgcatgatacggttagtcaagagttatttgcaacgagcatgattttgtcaggattatcgtccaatctatccactcttccgcaggaaaccttgcaggaacagctgatgctcgtgaaagacatgattgagtctgcccaaagagacctacgcatcctattattacatctacgcccaagtgaacttgaaagtaaaaccttggttgaaggatttgagttgattttgcgtgaagttagcgacaaaagtaatattatcgttcatttccaacatgaagtagaggagttaccgaaactaattgaagaacatctcttccgcattgcgcaagaaattatcagtaataccttgcgacatgccaaagccaagcatttggatgtttacctcttgcagaaggaaacagaacttcagttgaaaatgacagacgatggtatcggcttccaacaaggtgcagatgatgaattaagttacggtcttcaaaacatacgtgagcgggttgaagacatggctggaacgataaaaattcgcacagctccaaataagggagtggcgatcgatattcgtatcccactattgaaaggaaaagaagatgaatacgattcgagtgatgctggttgacgaccatgagatggttcgcctaggattgaaaagttacttaaatttacagccagatgttgaagtagttgcagaagctagtgatggcgaggaaggtttggctaaagcgttagaggttaaacctgatgttgtagtgatggacttggttatgcccaagatgactggcgtagaagcaactctggccttgctgaaggaatggccgcaagcgcagattgtcatcctgacctcctatctagataatgagaaaatctatcctgtgctggaagcaggagctcgtggctatatgttgaaaacgtcaagtgctgacgaaatcttagcagccatccgcaaggtagctcttggagaatatgctattgagacagaagtagagaaaaaagtagagcaccataaacgccacccagatttacatgatgacttgacagctcgtgaacgcgaaatcttgacgctgttagccaagggatatgataatcaacgaattgcagatgagtccttcatatccttaaaaactgttaagacccatgtttccaatatcttatccaaactagctgttagcgatcgtactcaagcagttgtttatgctttccagcatggtttggtggcgcaagaggaccaatagtggtataatgaaaattagttaatttttaaccaaaggatagtggaattatatggatgcaaaactcagatataaggcaaaaaaaataaaaatagtcttttttgacattgacgacacgctacgtgtgaagaatacaggctacattcctgaatcaattcagcaggtttttaaatcactgaaagaaaagggaattttgacaggaattgcgtcaggacgaacgccttatggtttggtgccagaaatcaaggccttaaagccagactttttcgctatgattaacggctcctacgtagaagatgccaaaggtcaggtagtgtaccatcagccgatgccccaaaatttagtagaatctgtattaaattgggctaaagaaattggaatcgaatatggtatgcttagtagtcaaaaagggacactttctgcacgaactgaccgtattagtcaagtaattgacttgatttatgaaggtttggaaacaaaaccaactttttataaagaaaatgatatctatcaattgttaactttcgagaaagatggtcacgaagtagaacttccagaagagttgcaagcagaattgcgtagtgttcgttgggatgctatttcatcggacattgtgttaaaaggctcttccaaagcaactggtgttgctaaggttgttgaaaaactaggcctgaaacctgaaaatgtcctagtgttcggagatggactcaacgatattgagttattcgattatgcaggaattagtatcgctatggggcattcgcatccagaattgcaaaagcatgcagattatatcacaaaaaaagtagaagaagatggcatttttgatgccttggagaaattaggtatggtagaaaaagaaaaatatttcccgcaattagatttggaaaatgttacaggaccagttgcgcatatcaagactaaccatggtaagttaacagtaaaactcttccctgaaattgcacccaaaactgtagcaaatttcgtagctctttctaaagatggctattatgacggaattatcttccatcgtattatcaaagactttatgattcaaggtggcgatccaaccggaacaggtatgggtggtgaatctatttatggtactgcgtttgaagatgaattttcaatggaagcttttaatctcagaggagccttgtcaatggccaatgcaggaccaaatacaaatggaagccaattctttatcgttcaaaaccaaaacttcccatacaatgcgaaagaattagaacgaggcggttggcctaaagaagttgcagaagcctatgtcaaaaatggcgggacaccatatctggatcaacgccacacagtgtttggtcatctagttgatgaagaatccttcgtcgtcttggatgctatcgcagcggttgcaacagattcagcagattgtccacatgaagatgttgtaattgagaccatcgaaatagaggattaagatgaaaatcggagataaactcaaggggacggtaacgggtattcaaccgtatggagcctttgtacaattagagaatgggacgacgggcctaatccatatctcggaaatcaaaacaggttttgttgataatatttatgatcatttaaaattggggcaagaggttttggtacaggtagttgattttgatgaatatactgaaaaggctagtttatcaatccggaccttagaagaagaacaacaaaaaattccgtgccatcatcgttttacaaatgaacggaataaaattggtttttcccccttagcaaaacaacttccgaaatggattgaggaagctaaaggctatctcaaagaacacaaagaaaagaaggtataggatgcattcctaaccttctttctttttaatcattgaactcataaagagctgttgacaagtaacgttctccgttatcaggcaagattgccaacacttttttcccagttcccaactccttagcgacttcgatagcagcgtgaattgctgcacctgaagaaataccaactaagaatccttcttttccaccgatagcacgacctgtagctaaggcatcatcggatttgacacgaataatgccatcataggcgctagtgtccaaagtatctggaataaaacctgccgaaataccttggatcttgtgcggaccaggtgcttcaccagataagacagctgattcatcagcttcaacagcatagatagcaatatctggatttgctgtcttcaaaacatgcgaaacacctgaaacggtaccaccagtaccaacgccagatacaaaggcatctaaaccagttgtgccaaagtcttccaaaatttcctgtcctgttgtatcttcgtgaacttttggattggatggattagcaaactggaaaggaacccagccatttttttcttcagcaatctcttttgctttggcgatagcccccttcatcccttcgctaccaggagtcaagacaagttcagctccataagcttggataatcttacgacgctcaacactcatggtttcaggcatgacgataatcacattataaccttttgctgctccaacccaagcaagaccgataccagtgttaccacttgttggctcaacaatagtatctccaggtttgattgtaccagccttttcagcatcttcaatcatagccaaggcgatacggtcttttacagaagatcctgggttaaaggcctctaatttcacatagacctccgctgccccctctggaacgatattattgagtttaataacaggtgtttttccaactaattgagtaatgttttgataaatagccatatggcacctccaaataatgttattatacattatatagtagaaagtcaaaaaaggataatataaaaaaactatctcgccgatagctttttttaatagacaggtacctcaacgattcgagagttagctttttccgtggatacttttccgtggtaaaagtcagtgagacttgctaaggtttgttcaaggaattctttatctacaaaaatcatggttgaaacttcagtagtaaactgggtatcaaattcttccagaccttgctccgctcgccaattggcaaactcttggtattgggcataggacatgctaagggaaatcccttcctgctccttaacttccacaaccccgatttccttgactgcattagccacggctccagcgtaagcacgaataagtccgcctgccccgagtttgatacctccaaaatagcgggtaaccaccgttgcgacattggtcagttcgtgattttctaaaaccgtcagcattggcacaccagcagtaccagacggctccccatcatctgaggaacgcttgatttccatattttctccaaggacaaaagcagagcagttatgagtagccttgtaatgctctttcttgattttgttgataaagtcgcgagcttcctcctcgctggtcactcgtttcataaagcagataaatcgtgactttttaatttcttcttcaacaataccatcttctctaattgttttaaattctttcataaccaaattgtactaatttttttaaaaactgacaagaaattccgaataaataagtgatgaaagaattagaaaattattatggaagattatttaccaaataccaattgacagcaaaagaaagagaaatagcagaaaaagtgccaagtattacaaaaaagaataactgctttcgctgtggaacaacttttgaagaagaaaacaaattgccaaacgatgcttattactgtcgagcctgcttgcttctaggcagagtacggtcagacgaaaaactctatcattttcctcagaaagattttccaatcactaagtgtttaaagtggaaaggtcaattaactgattggcaacaaagaatttcagatggactagttgcaaacgtggaaaataatcgtgcgacattggttcatgcagtaacaggagcaggtaagacagaaatgatctaccacaccgttgcctcagtgattgataaaggcggagcggtttgcctagccagtcctcgaattgatgtttgtatcgaactctataaacgtctgcaaaatgacttttcagttccaattagtttactacatggagagtctgaaccctatttccgaaccccattagttgtagcaaccacacatcagttattaaaattttatcaggcctttgatttggttttgattgatgaagtagacgcctttccctatgcagataatcccatgctctatcgagcagcagacaatgcggtcaaggaagctggtgttcaagtttttctgacagcgacttcaacagatgaattggataaaaaagtcagaacaggtaaattaagtcgtcttagtttgccaaggcgctttcatggcaacccacttgttgtcccgcaaaaagtctggtttagtaaattcgatgataccctaaagaaaaatagactagttccaaagttgaaaaaagcgattgaagaacagagaaagtcgtgctttcccttactcatttttgtcccagaaatctccaaaggtcaagaatttaccaagataatgaaaaaaacattcccagaagaaacaattggctttgtatccagtcaaacagaaaatcgccttgaaatagttgaagggtttcgcaagagagaaatcacagtcttaatctcgactactattcttgaacgtggggtgaccttcccatgtgtagacgtctttgttgttcaagccaatcattacctctacacagtgtcaagtcttgttcagattgcaggccgagtcggaaggagtatggaacgtccgactggtttactccagttttatcatgagggaagtacaggagccattgaaaaggcagtcgctgaaattaaacagatgaacaaggaggctggttatgtctaattgcctattgtgcggtcaagctatgaaaaataaaacaagattttcagatctcatcttctttagtaaagaaaaatcgggcatctgtgaagaatgtttttcgacttttgaggaaatagcagagcaacactgtccacattgttataaaaatggggaatcggaaagttgcaaggattgtcagtactggcagaatcaagggaaaccagttgtccacacagctttgtaccaatataatcaagcgatggcgcattattttagtcgctacaaatttcaaggagactatgttttaagaaatatttttgctaaaaagcttagaatagcgttaagccaatttcctgactacacaattgttcccataccaattagtcaaaaacgactatcagaacgcggttttaatcaagtggaaggacttttggatgctacaaatattccctatcagtcccttcttggaaagtatgaaagccaaaaacaatcatctaaaaatcgtgcagagagactagaagcaaaacagatgttctatctattagatgaaaaagaagtgccagaaaaaatattattattcgacgatatatatacaacaggagccacaatccaacttgctgtagaacttttcatgaaaattggtaggaaagaaatcaaaacattttcactaacacgataagaaaacggttgcaatatccctataatgtggtataataatagtgaagaaaggcgaaagccaagaaagaggtactaatatgattaaattcagtattcgtggagaaaaccttgaagttacagaagcacttcgcacctatgtagaagagaaagtggctaagattgagaaatatttcaatgaagaacaagagttgaatgctaaagtaaatctaaaagtttaccgtgacaagcgcgcaaaagtagaagtgacaattccagttggagcagttacacttcgcgcagaagatatttcacaagaaatgtatggctctatcgatcttgtagtagataagattgaacgccaaattcgtcgtaacaaaaccaagattgaacgaaagcatcgtcaaaaagtggcaactggtcaagtctttacagatgaacttgttgagcaaacaggcgaggaagtaaaagtggttcgtactaagcaagtagacttgaaaccaatggatatggaagaagcagtcctccaattggagttgctcggacatgatttctttatctatacagatgctaatgacggtacaacaaatgtattgtatagacgcgaagatggagatttgggtcttctagaggtacgtcaataaagataataaaacagttgcagtttttgcagctgttttatcattttcaaaaaaccggttgacaatgtatataagtcgtgatagaataaatgagttgtctcttgagggactagttaacagagaaacgaaaaaagtttcaaaaaagtgttgacaaagttcacaagaaatgataaactaagatagttgtcgcgagagcgcgataacgacaagacctttgaaaattaaagaagacgaaccaaacgtgcagggtgatttatctaaagataaatcgtcaatgacaaaacaaaacaataaaacggaaagctagcaatagcttgagtttgaatcaaaactttttatgagagtttgatcctggctcaggacgaacgctggcggcgtgcctaatacatgcaagtagaacgctgaagtctggtgcttgcactagacggatgagttgcgaacgggtgagtaacgcgtaggtaacctgcctcatagcgggggataactattggaaacgatagctaataccgcataacagtatttaccgcatggtagatatttgaaaggagcaattgcttcactatgagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaactgtgagaagagtggaaagtttctcacttgacggtatcttaccagaaagggacggctaactacgtgccagcagccgcggtaatacgtaggtcccgagcgttgtccggatttattgggcgtaaagcgagcgcaggcggtttgataagtctgaagtaaaaggctgtggcttaaccatagtacgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgaccgccctagagatagggtttctcttcggagcatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaaatggaaacctgtacgtcagtcttctttaattttgagaggtcttgtggggccttagctcagctgggagagcgcctgctttgcacgcaggaggtcagcggttcgatcccgctaggctccattaacaacggaagttgttaagattttgtccattgaaaattgaatatctatcaaacattcctaaacgtatgtaaaagtacgtatagaaatagtaacaagaaaataaaccgaaaacgctgtgaatatttaatgagttttctaatttttgaaaaaattaggttaaaacaagttacgaagacgttaaggaaaacgtatgattttaggaaatcatcgcagtagtctaaggactacaagaggatttgtctaaatcactagttttctagtctgagtacgattataaggttaagttaataagggcgcacggtggatgccttggcactagaagccgatgaaggacgtgactaacgacgaaatgccttggggagctgtaagtaagcaatgatccagggatgtccgaatgggggaacccggcaggtaatgcctgtcactcactactgttaaggtagtgaagaggaagacgcagtgaactgaaacatctaagtagctgcaggaagagaaagcaaaagcgattgccttagtagcggcgagcgaaacggcaggagggcaaaccgaggagtttactcctcggggttgtaggactgcaatgtggacttaaagagtatagaagaactacctgggaaggtaggccaaagagagtaatagcctcgtatttaaaatattttttatacctagcagtatcctgagtacggcgagacacgcgaaatctcgtcggaatccgggaggaccatctcccaaccctaaatactctctagtgaccgatagtgaaccagtaccgtgagggaaaggtgaaaagtaccccggaaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcggattagtattatgtcgtagacccgaaaccatgtgacctacccatgagcaggttgaaggtgcggtaagacgcactggaggaccgaaccagggcacgttgaaaagtgcttggatgacttgtgggtagcggagaaattccaaacgaacttggagatagctggttctctccgaaatagctttagggctagcgtcgacatttgagaatcttggaggtagagcactgtttggatgagggggccatctcggtttactgatttcagataaactccgaatgccaatgatttatggtcggcagtcagactgcgagtgctaagatccgtagtcgaaagggaaacagcccagaccaccagctaaggtcccaaaataattgttaagtggaaaaggatgtggggttgcacagacaactaggatgttagcttagaagcagctattcattcaaagagtgcgtaatagctcactagtcgagtgaccctgcgccgaaaatgtaccggggctaaaacaatttaccgaagctgtggataacactttagtgttatggtaggagagcgttctatgtgtgaagaaggtataccgtgaggagtgctggaacgcatagaagtgagaatgccggtatgagtagcgaaagatgggtgagaatcccatccaccgtaagactaaggtttccaggggaaggctcgtccgccctgggttagtcgggacctaaggagagaccgaagggtgtatccgatggacaacaggttgatattcctgtactagagtatgaagtgatggagggacgcagtaggctaactaaagcgggcgattggaagtgcccgtctaagcagtgaggtgtgatatgagtcaaatgcttgtatctgtaacattgagctgtgatggggagcgaagttaagtagcgaagttagtgacgtcacactgccgagaaaagcttctagcgatgtatcatactctacccgtaccgcaaaccgacacaggtagtcgaggcgagtagcctcaggtgagcgagagaactctcgttaaggaactcggcaaaatgaccccgtaacttcgggagaaggggtgctggcttaaagtcagccgcagtgaataggcccaagcaactgtttatcaaaaacacagctctctgctaaatcgtaagatgatgtatagggggtgacgcctgcccggtgctggaaggttaagaggagggtttagcgcaagcgaagatctgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctacgaagtcgggacgccagtttcgactgaggcgctgttgggatactacccttgtgttatggctactctaacccggataggttatccctatcggagacagtgtctgacgggcagtttgactggggcggtcgcctcctaaaaggtaacggaggcgcccaaaggttccctcagaatggttggaaatcattcgcagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggacgggataaacgctgaaagcatctaagtgtgaaacccacctcaagatgagatttcccataactttatgttagtaagagccctgagagatgatcaggtagataggttggaagtggaagtgtggcgacacatgtagcggaccaatactaatcgctcgaggacttatccaaagaaataaactagagtcaatattgacaagcgatcggtttcttgttagaatatagatattcaattttgagttgacaagactcagtagttaagtgacgatagcctaggagatacacctgtacccatgccgaacacagcagttaagccctagaacgcctgaagtagttgggggttgccccctgttagatacggtagtcgcttagcaaattgggagtttagctcagctgggagagcatctgccttacaagcagagggtcagcggttcgatcccgttaactcccataggtcccgtagtgtagcggttatcacgtcgccctgtcacggcgaagatcgcgggttcgattcccgtcgggaccgttgaaacgaatcaatcatatgtttcaagtaatataattaagtaaagactcgttagctcagttggtagagcaattgacttttaatcaatgggtcgctggttcgagcccagcacgagtcatatgcgggtttggcggaattggcagacgcaccagatttaggatctggcgctttcgggcgtgggggttcaagtcccttaacccgcatagaatggaaataggccggcttagctcagttggtagagcatctgatttgtaatcagagggtcgcgtgttcaagtcatgtagccggcattaggaaagattgcgaacgtagttcagtggtagaacaccaccttgccaaggtgggggtcgcgggttcgaatcccgtcgttcgctttgagaggccggggtggcggaactggcagacgcacaggacttaaaatcctgcgatggcaacatcgtaccggttcgattccggtcctcggcatgaagattataatagttagcacccttagctcaactggatagagtacctgactacgaatcaggcggttagaggttcgaatcctctagggtgcatcactcgcttaatggagacgttaggggagctttatttttaatagtatcgggaagtagctcagcttggtagagtacttggtttgggaccaaggtgtcgcaggttcgaatcctgtcttcccgattattgtaagagagcagcaatgttctttttttttggctctttgtcaactgtagtgggtagatgaaaagctaacacctagagaggacgaaattcgttctctctttcttgtttttaggagatgagctgaaaagagctctcctcagcttttcactgttcaaagcatcaaaatccgtttttctagtttccattttcctgaatccaaaggcatttcttttaatgactttgatgagattgttagttgtttctgatttggtgttggaaattgtgagttttgttgtttttcatactcaataaaaatcaaaaatagcaagtctaatttacttataacatgtaaaaccttaatttataagtttgagttgaggattgtggatttcaagtagctgtttttttctcaaaaaataacaaaatcaaaatgctccatatctactttgagtggtaggtggctatttttgattttaaatgggtatcagtgtaggtcgtaggggacttttttctacactcaaaaaggctctatatgaccatagtgggtttacccgtcatagtcttatagtgccttttattttttgcttagtttaacaaccgcctcggtccgtgctgtgtggggaaacatgtcaacagattgaatgtattctaccttgtaggctttgcttagctcaacaaggtcccttgcaagagtggagacgttgcaggatacataaaccattttagctggtttgtaattcaaaatggttttgaggagcttttcgtcgagtccagttcgtggaggatcaactaccaaggcatcggccctgtagccttcttggtaccactttggaatgatttcttctgctttacctgcctcatagtgggtattggatagtcccattcgcttagcgtttgctttagcatcctcgatggcttctggaataatgtccatacctcgaacagatttgacctttttagcaaaggcgaagccgattgtacccacgccacagtaggcatcaatcaagtcttcatctcctgaaatatccaaagccttgacggcctcgccatagagaatttctgtttgttggggatttaattggtaaaatgcccgtggagatagtgagaattcgtaatctaaaacagcttcatcgatagcttgttctccccataaaatttctgttttttcaccataaatatcactcgttttctgtctattccagtttagagcaatagtgattatacttggaaattgactggtgagttcatcaattaatttaataagattaacctgacaagaggtgataaatatcacttgaacttgacctgtttttcgagccttgcggaccatgaccgtgcggattccatgttgcttgcgctcattataaataggaatacggtgcttggtgagtagctttgcgattccgttgataatctcttgtgtttcggcatcttggacgtaacaattcgtaattccaatcaagcgatgggaattttccgcatagagaccggccttgacttgatctttgaaagatcgagtctggaactgtaatttggcacgatagtggctaggcttatccataccgattgttggataaatagtatagttttcgtagccagctggtttgaacttttttagggcctgctgcaagagatcttgtttgaagtctaattgtttatcatagcggaggtgcatgatttgacaaccaccacaggctcgatagatgtcacaggccggcttgacacggaattttgattccttgttgatttttaacaattttgcttcaacgaaatttcgtttgactgaggtaatttgacaaaaaatttcttctcccttaagggcaccagggacaaagactagcgttttttgataaaatccgatgccttctccgttgatgcccattcgtttgatttttaaggggattcgttggtttacttgtagattcatattattattttaccgaaaaatcctgtataatgaaagaatgagaattacaaaaattgaaaagaagaaacgtctttatttacttgaagtggatggtcaggatagtttatatattacggaagacacaattgttcgcttcatgcttagtaagggaaaggaaatcacggagcaggagtttcgtgagcttcgcgattttgctcagttttcttatgggaaaaatctagcactttattacctttccttcaagcaacgtaccaaaaaagaagttagtaattatctaaaaaaatatgaaattgaagaaaacaatattgtcaagattgtgacggtattagaagaggaaaaatggctggacgatgggaattatgttgatagctatgttcgtcagaatgctctaaatggagataagggaccagctatgattcgtcagaagttgatgcagaaaggaattcctaaaacgctgattgataaaagactggctgaggaagatttttcagagcttgctgggaagattggggagaaattggtgggtagataccaaagaaaattgcctcttcgagctttgcaagataaagttgtacagggattgatgggtaagggtttttcttatgaggcggccaaacaaagcctgggtcagttggaacttgtggctgatgaggaaaatgaagatgatttaatcgccaaggaattggataagcagtatagaaaatatagtcgtaaatatgaaggctatgaattgaagcaaaggttgatacaggctttggctcgaaagggttatgactttgatcggattcaggctgtccttcgtgattatctgtgaaaaaatttagcctaggttagaaaaatatgatataatagtcaagataaattgtaattgtagaaagttggtaacaaagtgaaattaccaaaggaaggcgactttattacaattcaaagttataagcatgacggtgaaattcatcgcacttggcgtgacaccatggtattaaaaacaacggaaaatgctattattggagtcaataatcataccttagtgactgaaaatgatggtaggcgttgggtaacaagagagccagcaatcgtttattttcataaaaaatactggttcaatatcattgcaatgattcgtgaaaacggagtttcctattattgtaaccttgctagtccatatgttctcgacaatgaggcactcaaatacattgattatgacctagatgttaaggtctttgctgatggtgaaaagagactgctggatgtggatgaatatgagcgtcatcgtaaggcgatgaagtattcggatgatattgattttattttgaaggaaaatgtcaagatactggttgattggattaataaccagcgcggaccattctctccagcctacgttaatatctggtacaaacgctatttagaactgagaagtagataaagttagaaaagaaaatcctgttttacaggcttttttcttattgtaaaggaggggcttatggcctttgaacaaacaaatgggcgctatgcaagttttggagttgtgacttcgcttcctggggaagtgattgatagtttctggtatgttattgatcactacttaaaaggggttattccattaaaaagtgtaatccgtttttctatcaaaaatcgtcgtggtaagattacgctggtcttttcgcaggaaggttataaaaatgtactggctgtagatctaagtagtcgttttgatcctttttatccctcaacaatcttggtaatggacaagcagggaaaagagaccattactttgccagatgaggtaaccttgctttagcttgaagagctggtattttatcacccaagatattgttaatatatgaaatttggtgtaaaatagatttgtaagcttatgtgggttagaaaggaggagtctatggttagtcaaactgttgaaaaacctctctatttgcagttggttgatgaattagaagttgcaattcgtgagaggatggctccgaatgacaagttattttcagagcgtgagttgacacaggtttatggtgtcagtcgtattacagttcgtttggctttgcaagaattggaaaaacggggcttagtctataagaagcatggtaagggaacctatgtatctgagatttcagatactgcagttgatttgtctcaggcctatagttttactgagcaaatgaaaaaaattgggaaagtaccgaggacatctattttatcctttgaattggttaaggcgtcagactatattgcgcagcatttacaacttagtcaaggtgaggaagtgtttgaagttgaacgattgagacttgccgatgagattccgatgatgctggaaaggacatatgttcctgcttcggtatttcctggattagctgctcagcgaatgaagtcaactcccttgtatgaaattttttcagaggattatcatcaggtgattcgtttggcagaagaagagttctatgcaagtattgctttggataatgaagctaagatactcggaattccaagcaatagtccagtgcttcatttggtaagaaaaacgtataatgataagaatagaattatcgagtttacgtttagtattgctagagcggaccagtttcgttacaagattacccatcaacggggatattagaatcaatactcttcgaaaatcaaaattattcgttgtcaagagccttgatgaaatccagttctatcttcggcttcgtttcctaggctacttttgattgttattgggtatgaaaaaaacgcggacgttagtctgcgtttttttagcgatggttggctgtaatttcaaatttgtaatacttccagtgcttgtaagtttcagtatattccatcacttcaccgctagtactgttagtagttgttttgttttgtagtacagctggttcagtcgcttttaatttcaaatgggtggcaacctcttttggacatgggctgacaatttcattcgtttctacaaatggttcctcggacatgtggatattgtagtccagtttgaagcgttgatagattgattgatagtgctcgagtggagcatcgggattctggatatatcgttgagggatgtatgaattgtggaagatgtatggagtgtcttctgctgcgcggacgcgtacaattttatagtaaaactcattcttgtcaagatttagtttttcaaggatatcgggtttattgcctttttcgcacgagagaacagtaaccttatccttatccatcggaaaaatctcaatatcagaaaattctacaagacgtcctttacgtgaacgagatacaaaggttcctttaccttgttggcgaacgaggtaaccatctttaactagttcgtttactgcacggataacggtaatggagctaacattaaatagttttgttaattcagattctgtgtaaaatttgtcgccattttcaaatttgccagaaacaatctgttggcgtaagtcgttttgtataagttggtacttcggtactttcatacttatttccttcctttccacaacttattatactaaattagttgatgaaaatcaaaaaatatagctaaaatacccacaaaaatatactttttcactttataaaggtgataagaaatggtaaaaaaatttttaaaaagtactggacataaccacaaagaagtgttagtatattaatagaaaggtaagcggttgcatcggaggaagaaatgaaagaattttatattggagaccaattttatttggacggtgaaccctttaagattttatcaggcgcgattcattattttcgtgtccatcctgatgattggtaccattctttgtataacttaaaggcccttggttttaatacggttgaaacctatgtcccttggaatatgcatgagcctcgaaagggtgagttttgttacgagggtatattggatattgagcgatttttgaaattggctcaagaattagggctttatgcaattgtacgaccgtccccctatatttgtgctgagtgggaatggggtggcctccctgcttggttgatgaaggaagagcttagagtacgttcgagtgattcggtgtacttgcagcacttagatgaatattacgtttctcttattcctaaattggccaagctccaactcgcacagggtggaaatgtacttatgttccaagtggaaaatgagtatggatcttatggtgaggagaaggcatatttaagagcggtggctggcttgatgcgtaaacatggtctaactgctcccttgtttacctcggacggttcttggcgagcaacattacgtgcaggaacactgatagaggacgatgtatttgtaacaggaaactttggttctaaagctagagagaattttgcaaatatgacggcattctttaatgaacatcagaagaattggccactcatgtgtatggaattttgggatggttggttcaatcgttggggcgatgaaattattcgtagagagccggaggaaatggttgattcagttatggaatgtatcgaattgggctccttgaatctgtacatgttccatggtggaacaaattttggtttcatgaatggttgctctgctcgtggtcaaattgatttgcctcaggtaacttcttatgattatgatgctatattggatgaagctggaaatcctactaagaagttttatattttgcaacaacgtttgaaagaagtctatcctgaattagagtatgcagaaccgcttgtaaaagaggcaaaagctttttcagatgtgtcgcttcatgataaggtgagtctgtctgctactctagaaaatgtaagcgattgcgtaaaagggttttatcctaagaatatggaagaacttgatcagtcaacaggttatattttatatagaacagagttggagcgggataagacagaagcagaacgtttccgagtggttgatgcgcgtgaccgtatccaaatttatgcagatggaaaattcgttgcaactcagtatcagactgagattggtgacgatgttgaattggattttaaagatgacaagctaacattagatattttggtagaaaatatgggacgtgtcaattatgggcacaaactaacggctcctacccagtctaaagggattggtcgaggtgcgatggctgatttacattttattggtcattgggaaacctatcctttgcatcttgagtcagttgaggacctggattttagtaagggctgggaggaaggtcaagctgctttctatcgttatcagtttgaactggatgaacttgcggatacttacttagacatgacaggttttggtaagggagttgttttcgttaataatgtaaatattggacgtttttgggaaaaaggaccaatcctctatctctatattccaaaaggatacttaaagaaaggagcgaatgaaatagttgtcttcgagacagaaggaaaatatagagagaagattcatttttcacaaagacccgttataaaagacttgtagaaattttaatcggtttctgctcaaaagatttatgaagaaaaggagaacactgtatggcaattattgctacgcgtattgatggtcgtttgatccacggtcaggttgctaacttatggacgacgaaattgaacatcggtcgtatcatggttatcgatgatgctgttgctcaaaatgacattgaaaaacaaggactgaaattagcatgtcctccaggcgtaaaattatcgattttaccgatcgaaaaggctgctaataacattaaggaagggaagtacgatagccaacgtcttttgattgttgcccgtcgtcctgaaaacttcctacgtttagttgaatatggagtggaattggcagaattgaacgtagggaatatgtctcaaactccggaaactcgttctgtaactcgttctattaacgttgtagataaggatattgcagattttgatgccttggcggctaagggtgtaaaattatttgcacaaatggtacctggcgattcaccaaaagactttatgccattattggataaggttagataacattcggatatttttgaaaaatttaaaggaggatcactattatgcaatggtggcaaatattacttctaacgctctactctgcttaccagatttgtgacgagctgacaattgtatcgtcagcaggttcaccagtctttgcagggtttatcactggtttaatcatggggaacatggaagttggcttgctaattggtgcaagtttgcagctagttgtcttgggagttggtactttcggtggtgcgtcacgtattgatgcaacatctggtgcggttcttgcgacagctttctcaatttcacaaggtttagatccagaaattgccatttccactattggcgtaccagttgcaggattgttggtttatacagatattttaggtcgtttcaccactactttctttgctcatcgtgtagatgcagcaatcgaacgttttgactatgctggtattgaacgcaactaccttcttggtgcaattccttgggcactttctcgtgcacttccagtttttcttgcccttgcttttggtggtggtcttgtagaaactcttgtcactacgattgagttgcctgaatacaaatggattgcagcaggcttaactcttgcagctcgtatgcttccaggtcttggatttgcaatcttacttcactatcttccacttaaacgtaaccttcactacttggcggtaggtttcgctcttacagctatgttgactgttctttacggtaacgtatcagctttgggtggtgcagttgctggtatcgttggcactcttcctgaagatgcaggcgtaagctttgtcaataacttcaaaggtttgtcaatgattggtatcgctattgtgggtgcatttctttcagtgattcacttcaaaaatagccaaaaagtaactgtggttgctccatcaaattcagaaagtggggaaattgaagatgacgaaatctaattacaaattaacaaaagaagattttaatcaaatcaacaaacgtagcttgttcactttccaacttggttggaactatgagcggatgcaggcatctggctacctctacatgattttgccacaattgcgtaaaatgtatggagatggtacacctgagttgaaggaaatgatgaaattgcatactcagttcttcaatacttcaccattcttccataccatcatcacaggtattgacttggcacttgaagaaagtgatggtgttgcttctaaagatgcggttaacggtgttaagacaggtttgatgggaccatttgctccaatcggtgactcaatctttggttctcttgttccagcgattatggggactgtggctgctactatgggtaaagagggatctccagttggtatctttctttgggtagcagtagccattgcctatgatattttccgttggaaacagttggaagttgcctacaaagaaggtactaagttgattacaaccatgcgcgatcgcttgacagctctcgttgatgcagcatctgtaatgggtgtcttcatgatgggtgccttgattgcaactatgattaactttgaagtgacttgggctccagctattggagaaaaagtgattgatattcaagacattttgaataccatcttcccacgcctagtacctgcaatctttacaggatttgtcttctggcttcttggtcgtcgtggcatgacttcgactaaagctatcttgattattattgtgcttgcacttggcttctcagcaatcggtcacttcctatttggtatggtataatggttagaagtttagtattagtaagtcatggtatcttctgcgaggagttgaaaaaatctactgaaatgattatgggtcctcaagaggacatctacacagtagctttattaccagaagaaggtccagaagacttccagaaaaaatttgaagaaacaattgcaggattggaagattttgttgtcttcgcagacttgttgggcggtacaccagccaacgtcgtatcacgaaaattgattgaaggtgggcagtttgacctttatgcagggatgaatatgccaatggttatcggtttcttgaacggcgtcctgctgggagaggctgtggattatgtagaatttgggacaagcaacctagttcatgtcaatagtctattaacaagtgatgaagatgacgatgagtgaaacagtttgggaaactgtttccactggtcaccttgaaatgaaagagtgaccaaagacagcccgagcctagaaataagagagtgaggctaactcagctgattgttacagacggatttgattttcgttaattataaaatgttctatagttgataggctttaagtatcctgaggaagttgcaatagtgactccctcatttggcttgtgaggaaaagaaatgattgaagtaaaaacatttgatgaaaaagcaaaactgtattgcttggaaaacaagaatgggatgcaggtaaccttgacggattttggtgccagagtggtggaagtgcttttgccagtagaagaaaatggcggtctacggaatgtcagtttagctgccaagtcggatgatgattaccgtaagacagatttgtaccctggttcaactattgtcccagtagcggggcgtatttcaggtgcccaagctgagatagagggaacaagctaccatttcacagaaaatgaacctggtaggactctacacggtggggttgacacggcaaatgagcagtactgggacgttgagctagaccatgagagaaatcaagtgacctttggtatggtcctaaaagatggttttaatggctttcctggtgatgtgagggtcaaggctatttattgtttgacggataaaaatgaattgacagttgactaccaggctgtatcggataaggatacgatttttaatccgaccaaccatatctatttcaacttgactggtgattttcaacggtcagttgccgagcaccgtattaaaattgctgccaatcactatgctccgcttggggaggataacctgccaacgggtgtcttagaagatgtgacagggacgccgtttgattttagagattttgcgccttttgctcagggatttgatagccaatatcctcaaaatgtgttggtaaaaggctatgaccacccatggttattggaagaggtggatattccggtagaagttttgagtccagatgggaaaattggactcagtgtcaaaaccaaccagcctgcggtcgttatttatacatataattttcctgttgaagctttggcctgttaccatggtgtctttagtttagagtgtcaggccttgccaaatgcatgcaatgtcgatggatttggttcgattttgttagaacaaggagaagaatttttgtctaaaacgacctatcgttttacttggtaaaaaaatggggactctaactgtgttacagttagggttttcttgtgttttctagaaaatatggtataataaaccggtgtgtttcaatcgaagcaggcgaaagaggaaaataatgacaaaagaacaagaatttttaaaagaatttgaggcttgggtcaacactcaggtcatggtaaacgagatggcggttgaagaaagtcgtcgtgtcttggaagaagacaaggatgagcgtgcagcggatgcttatattcgttatgagagcaagctggatgcctatcgattcattcaagggaaatttgccaactaccatgctggcaaaggttttcatgatttgccagatgagttgtttggtcaaaggcattattaaggagaggagttaacatggcaaagaaaaaagtaaatcgaaaaaaacaattgaaaaaacaattagcagacttgaaacgtgcaggtcgtgtaggtcttgaaagagctgcagaggtagtagagacagttgctcacaaggctgaggctgtagtagagcgtactgtggaacaagtgaaagaagttgtagcagaggtgacttcttcagcgacttcattggaagactttttggcgcttcctgagttggaaggcattgcggcagcacgtttggaaaccttctacgaagcaggtattcaatctgtggctgattttgcaaaccatacagaaaaagagctcttggctcttaaaggcatcggtcctgcaactatcaagcagttgaaagaaaaagggattgagctgaaagcttaaatcccttgcttttcaaggtacaatttgttacaataaagccattcagaggtgttttgagccccatttgtcacaggaagcggtggtactgagaaatccgcacaaatgtcaaaactggttgctgatgatgtgaatcgaataagcaaagtgcagataatgtatctgaacaagggtggtaccgcggaataacttcgtccctgtctagcaagtctaggcggggattttcatttggaaaggagaagatatgttacatcatgttgaaatttacgtttctgacttggaaacttcgcgtgcattttacgactttctcctgaccaagctgggctactcgctctatcaggagtgggataaagggctgtcttataaaaaagcagagcaatacctggtctttgtccaaacgccagaggacttcctagaggtaggctaccaccgttgccgcacaggtctcaatcatctagcttttcatgcagggacacctgatgagattgaccaatggcggaaggaatttttgaccagacgagtcaaacttctctacgacgaccgctatccccacgcaggaggaccagaccactatgccctttatttggaagatccagatgggataaagatagagttggtgggggagggggtatgaatctaattattattggagcacaagcttctggcaagatgaccgttgggcaggaagttgcgaaattgacagggatgaccctttttcataatcacgattcgattgattttagcctacgttttattcctgaattttctgaggatatgtttgacctcaatacacgtattacatttgctgtttatgatgtgtttgctaggtcaggccgtccactaatcggaactgccttgattaattttaaaaatctcatagaggttcaattccttacaacagttcagacgatttttcatcatcatggccaggaaattttatttgttgagttggaaaccgctttggaagaacgtttgcggcgtaatcggacagaaaatcgacttacccataaacctttgaaacgacacattgaagtttcagaggctgagattctctctacagctgatacatgtcgatatacctcgttaggcattccagagggcattcagcattatctcaaaattaataatactcatctttctgccaatgacgtagctcaactaattatccaaaaaatggaggaacttgagcaagaacaaacgaaatagccagcccaaaggactgactatttctaggagattatatgaaaaagaattgggctatttctagcttgaagatagtataaaccaatttttttaaagaatactgaaggagaaaaaataatgtcaaaagaattatcaccaaaatacaatccagccgaggttgaggctggtcgttaccaaacttggttggaccaagatgtttttaagccgtcaggcgatgcggaggctaagccttattctatcgtgattccacctccaaacgtaactggtaagttacacttgggacacgcttgggatacaacccttcaagatatcatcatccgccaaaaacgcatgcagggatttgataccctctggcttccaggtatggaccacgcggggattgctactcaggctaaggttgaggaacgcttgcgggagcaaggcgtgacccgttatgacttggggcgcgaaaaattcctcgataaagtctgggaatggaaggatgagtatgcagcgactattcgtgaacaatggggcaagttgggtctgtctttggactaccaacgtgaccgcttcacgctggacgaaggcttgtcaaaagccgttcgcaaggtctttgtagaactctacaaaaaaggctggatctaccgtggtgaatttatcatcaactgggacccagcggctcgcacagccctttctgatattgaagttatccacaaggacgtagagggtgctttctaccacatgaattatatgttggaagatggttctcgtgcccttcaagttgccacaactcgtcctgaaaccatgttcggtgacgttgcggttgcagttaacccagaagatccacgttacaaggacttgattggtaaaaatgttatccttccaattgtgaacaagccaatcccaatcgttgcggatgagcacgcggatcctgaatttggtacaggggttgtgaaaatcactcctgcgcacgatccaaatgacttcctcgttggacaacgccacaatctgccacaagtcaatgtcatgaacgacgacggtactatgaacgagttggctggtgaatttgcaggcatggaccgctttgaagctcgtaaggcaacggttgctaagttgcaagaactgggtgcccttgtggaaatcgaaaaccgtgtgcattctgttggacactctgagcgtacaggtgtggtagtcgagccacgcttgtcaactcaatggtttgttaagatggaccaattggccaagaatgccattgccaaccaagatacagctgacaaggtagaattttacccaccacgcttcaacgatactttcctacaatggatggaaaatgtacacgactgggttatctctcgtcagctttggtggggtcatcagattccagcatggtataacgaatctggcgaaatgtacgtcggagaagaggctccagcaggtgacggttgggtacaggatgaggatgtcctagatacctggttcagctctgccctttggccattttcaaccatgggctggcctgacgaaaacgcggcggacttccagcgttacttcccaacctcaaccttggtaacgggctatgatattattccattctgggtgtctcgtatgattttccaaggaattgaatttacaggcaagagcccatttaagaatgctctgattcacggacttatccgtgacgaagaaggtcgcaagatgtccaagtcgctcggaaacgggattgacccgatggatgttatcgagaaatacggtgcggacgctttgcgttggttcttgtcaaacggctctgcccctggtcaagatgttcgcttctcttatgagaagatggacgcatcttggaacttcatcaacaagatttggaacatttcccgctatatcctcatgaacaatgaaggtttgaccttggatgcggcgcgtgagaatgttgccaaagtcgcagctggcgaggctggcaacgtgacggaccgctggattctccacaacctcaacgaaaccattgccaaagtcactgaaaactttgacaagttcgagtttggtgtggctggtcacatcctctacaacttcatctgggaagagttcgccaactggtatgtcgaactgaccaaggaggtcctttacagcgacaacgaggctgagaaagtcatgacccgctctgtccttctctacacgctggaccaaatccttcgcctcctccacccaatcatgccgtttgtgacggaagagattttcgcccagtacgcagagggttctatcgtggtagcggcctaccctgttgtcaacccagcatttgaaaatgcggaagcccacaagggagtggaaagtcttaaagacttgatccgttcggtgcgaaatagcagagcagaagtcaatgttgctccttctaagccgattaccattttgattaagacggcagatagcgagcttgaaaccttcttcaaggcaaatgaaaactacatccgccgctttaccaacccagagcagttggaaatcagctcaagcatcgctgcaccagaactagccatgtcagccgttatcaccggtgctgaaatcttcttgccactagcagaccttcttaacgtcgaagaagagttggctcgtctagacaaagaactcgtcaagtggcaaaaagaactagacatggtcggcaaaaaactcagcaacgaacgcttcattgccaacgctaaaccagaagtcgttgaaaaagaaaaagaaaaacaagccgactaccaagcaaaatatgatgcgacagtagcgcggattgaagagatgaagaagttggttaagtaggtagaatacgataaaatgcccagcctaaaatggctgggttttgtggtataataaaattaatacattaggagttttatatgatgattatattaatttgtctttccttatttattataagtagaacaatgaatggctttcgattatttctagattctacaattattatagggtttatttgtctgtttttctattattgttgttttgacttaatttttattagcttgacaaatttggttttaatactaattttgttagtttattctttctcagacatcctttttggaattagaataataggcctaagtataccatttattagaagtattgttctaaaatatattgactgtaagggatttttacaaaataaaataaggaatcacttagttgaaattagagaaattatattagttacattcctttttctgatttttggggttcaggttcaacttcaactaccctatatcaattttactaattatagtttaatagaaatattaggatttgatatcgcaatttttagtttatatggtatctatgtagcttttttacagtttttaactgaaaatgataaagtttattacttaggtgttagtaagattcgcttcatgctagataattcagtgtggtcgcagctaaccagagctaaattatttcatattattctattagtgtcggtattaataccgttgttcagcaaaagtaatatagaatttaattatcagcttcagaatatagaatatctgtggcaaacctgttacattatttctatcgtggtttatatctttttgctgaaacttagtatcagtattgtatatggggtttttagattaaatttagaaaatgtaagtaagacggttaaaaaggaagatgttaaggaaaaagatagtagacataaagaaaaaatttttaatagatttggtatcactgataaaattaatatctcagtacaaaggtcctttaaggatgagttttggaaaatttataaaaatcaaaatcaatatagggatgattatataaaagtaagacttcaagagagaattacattggttgagaaagctgatagggatgaattaatttttactatttttggcagagaaaattgggaaaattataacttatcagaaagtatatttgtatttatagaaaatatagatagtgatgaaggcaaacaattctttaggttttataagaatttttgtatacataaatggaattttttaagagattatcaaaccgatatatcccctagaacatgggtaaaactagtagagcaggatattcttatttttgacaagttagttaaatccgattctacgttcaacatattcaaaattgaattttcagataatgccatatcacgtaatttgaatcttgaaaaaaataagaaaataaaagaatttttatttgaacttttacttgataaagaaggtgtcaatttagatgatgtattaataagtataaaaaaggaaatacaacgtttttcacagaataaatcagatcaattttatagatatacatatgattttttaaaatttagattagtaacaattttagataagtatgaaaatgatgatgtaaatataaatttaccagaatataaaagtctatccgatgcgtttcaaaatggccagcgaaatgattatgaaaacagtatactttattctaaaatttgtttcaattatttagatagaggaagaattgaagattttagtcatacaaaagttgaagcagatgatagtaaagagcgggaaaaacaaaaattaaaagctcaaaaaatacagggattgattctgagcatgaatgaagaataccgaatggcatttatgctatatcaattattttatacggatcgtactcaatgggatgagaatctggcattttacgataataatattcaaagtataatgaagcatggtaagcaataccatggttatttattcgatcaagtgaaaaatattattctaagtgagactgatattgatcatcgtattacagaatcttttttagacaagatatgggaaacaaaaaatgaaacaattatggatttttcatggtttgatcaatttggggatcaacatcagatgtcgaattttaaaattctttacgtacaatggatattatcaggagcgacaacttcctatttgaagagtagaattaattttgaaagagggtttcctattaaagtacgcaattcacttgttggaaaaataaaaggaaaagaaaataggaagatgtcagttaaagatttgaaatggaggattagacgtaaagaagaaaggattggtcatctttgccgagactatctattattaacagatcagttaacgactatttttacaaaagtaccatctgataaacataatttacaaatatcagttgaatatcttttgcacagtggtaaagtgaatttatcggatgttatagataatatatcagtaacaagtttacttcgcttggaatggcttttgagatggaactattatcattatcatagggagtcaaattatactagcagaacattctttgacgaaatgacctctaatgaccgatattattggtctgctggacgtggtattttagaatttttcattgccaaaattgttgacaatttttatcgtgatttataccaagataaagagtttatggctggttttaaatatcatttagagtcacaattaaattcattaaataaaacagttgaagagtatgtggagttgattgctgaaagagtttctggaattgataatctttcaattctacagaaaggacaaattatttccaaattgaattatattttatttggtcaagataataatattaaaataagacaaaaagaaaatatcgctataaataaattttaagagctccattggacatagaaaaacttgagattttatcaagcgttaccaatctggaaatcgtctaaaaataaaaacaagctgactaccaagcacaatatgatgcgacacaggagcggattgaagagatgaaaaaactggttaagtaggtagaatacaacaaatgcccagcctaaaaaggctgggttttgtggtataataaggttagaaattcaaacaggaggagtctatgcaaccaacttacaatattgataatcccaatctttcctacgaagccaagcaagaactctgggaaacgggttttggtcttcaaaaagtggatgggttgactccgtctgtttatatggaggagttggcggaaaggcaagctcgtggagagtacacctatgagcaggtgtacgaggagattacgaaataccaccagtcaactgacgccagtacgcaagaggcagacattgtctctctccgaattgttgaaatgctctcccaaaatggttttagcctccgaccaaccactctcttacatatccacaaagagctctttcacgatatttttgacagcagtattccagtagttgaataccgcactgtcaatattacaaaaaatgaattagtcttaaaaggtgatacagtgatttattcagattttcccttgattgccgccactttggactatgatttccagcaagaaagggatttttcttatgctaggttagataaaaaagccatcgtcgctcatatccaatcctttatttcaggtgtttggcaaatccacccattccgtgaagggaatactcgaacaatcaccgtatttctcatcaaataccttcgctcacttggttttgagattgataatgagccttttcaaaaacatgcaaaatatttccgtgatgcgcttgtacttgacaatgctaagttagtcaataaacgctcagattttttaactgccttttttgaaaatctcctcttgaacggtcagaatgatttatcaagtgagaggatgtacgaggagttggggttagatgaatatcaataaagacaggatagttttcaagtcggaaatagaccagtgaatacttgggcttttgacttttcgttgataatctcgttaggcaatttggagaaatcgtatgtcctattattatgaaaaattaacgggtaaggttgcaaagcatcttgctcgttttccctattatgctaccgataagattctgaatttaatgcaatttcaagataacaatcagcaatttctgataagtgataagcatttgtatgattactttgaagaacaaaaacatcaactaagtaccgatgaaaaactctccattctgttcaacctatttaagggacgtatagatgtttatgcgaaatcttatattgatgaaaatggaaaaatcaactattttccttcttacaactatggttggaaaaaacgtcctgttgaaaagagaacttgtcaaccattgaccaaacaggtattattggctcacctacgtggcgaaatcagtattggtatttttccaatgagtttatcagacacgtgttcctttttggcgattgattttgataaaaataattggagagaagaggtctccattctaagagatacagcagaacaacatggttttgaggggcatatcgaaatctctcgttcgggcaatggtgctcatctctggtttttcttcgaggaagaaattgcttgtcagcaggcgagaaatgttggaaaaagactgctggaattggctatgcaggagtcaaaagatattcgcttttcttcatttgaccgtatgtttccaaatcaagatattctgcccaagggaggatttggcaatcttatcgcactgcccttacaaggggaagctttcaagaagggaagaaccgtttttgttgataaacattttcagcccttttctgaacaatggacctatcttcaacaggttcaaaagattggacagaagaaaattctagatttcttaggacaggagttttcggatactgtagatgatacagtattagattgtagcttatcaaacgttattcgagttgagaagagggctatttcttcaaaaacaaattacttattgagaaagctggcatcttttcctaaccctgaattttatctaaaacaagcgaccagacaaccaacctatcagactccagaacgcatctatttatttgaagaaacaaacgaagccttgcatcttccaagaggaatacttgctaagctacaggaaatctttgaaacggtaactattagggacaatcgcaacagtttatctccgattcagatttctttcaaagggaggttgcgttttgagcaggaacttgctttggcagatttattagctagtgagaatggcttgctatgtgctgaaacaggtttcgggaagacagttttaggggcagccttgattgcccagaggaaatgtagaacgattatcttagttcacaatcgtcaactgttggagcagtggttggaaaggttgggtgaatttttagagattgaagaggaagaggcagttcgctatactccttcagggcgtgtaaaagtaatagggcatattgggcaatatggggcttctaaaaaatggaggagtaaattggtggatgtggttatgattcaatccctcttccaattggacgtgatttccgactttttgtcggactacgatatgatgattgtagatgaatgccatcatgtgacagccttgcagtttgaaaaagtagttgctcaatttgctagtcaatatctatatggcctaacagcaacgccagagtgtaaaaatggacatcaaccgattgtctttcagcgtattggtccaattttacatactgctcaatcaggtcaatacgattttaaaaagaggttactactccatctaacatcttttgggaaattggacttggaacagtcgaatagtacgaactttgcatcccttaatgattggcttgccaaagatttacatcgtaatactttgatcgtgcaagatattttcaaactatatcaagaaaaacgaaacatccttgtcttagtcaatcgacgggaacatatagaattattggaaaagctacttattgaaaaagaaatgcccaatattttttgtctgagtggagcgagtaaaagaagagatacgaaagaactcctgaaaagaatcagtgagctagatgagaatagtccatttgttctcatttcaacaggaaaatttattggagagggcttcgatatgccaaagttggatacattaattttggccgctcctttgtcttggaaaaataatctcatacagtatgcaggacggcttcaccgtccctatcaaggcaaaactgaggtgagaatagttgactatcttgatatacacgttccctatcttgaaagaatgtaccagaaacgtcagatagcctatcgtaaaatggcctatcaggttggagagaaagaacaaacccaagtattattcagtggtagggactacgaggagaaatttagagaggatttgcggaacacacgttcaacagtctatttacaattgcattcgttcacttctagtaggattcaagaattattgggactgctccgaggaaaacaagtagttattcatgtttccaaaaatcataagttaagtgagtggctaatggggttaaacagtgacaatgtaaaggtgaagcttgtaccagaaaggattggtacgaccgcagttatcttagatagtaatctcgtttggtatggcaatttatcccccttcacatatcagtcggatgaccaagctagtttgttgagattggaaagtcaatctattgcaactgagttgcttgaaaaatttgagaattcaaatattaaataaaaaaatccgaatactgttctgttcggatatttctttaaaaaaagaactgtatttgtattaaaatttaatattttgtataaaaaatatgataaaataatgagaaatggaggtgcatatggaaaaagaagtgtttactcccgatcaaagtcaatctattgtagatgctatattgaagggatacaagtcctatcttgatgagcgaattgaaaagagaagaacaatgcatgtttctgctggttatgtttggactaaagctaatcatatagatggtgctcttgcgactgcaaacctaaattttattgataaatttgagttgaaacatgcgagtcaatcttgggagtttttagaatttaactcagaaaatcaactattaggacgtgtatgttttgttttaaaaggtcttactcgcttgcggcaggtttttccaacagcagtaaaaagtggaaagggctatttatttgactatgctcaaattaatacaagttacctagaaaatctttcaaggcataccgatgaaagtacgcttttccctgttcagatggaattgtttgatgacaatttatttgaacttttgaatcggtctgaacaatctatcaataactttttctttatcacatatcaggctgatgaattacatcacttgacgaatattcaagttatcatgcctgattcaagaactgggaaattgattgaaattcaaaatttatcaacatttatttctacaagtaatgtcgattttaacgatgaaaaatatcaagagttacaaggcttatcagagattgatgatgtagctgattttgagattataccacgtcttgcttcagaaaaagaagcttagaaaggcaaaaaaatgttcaatggttcaagactggaagaattacgacttctgaatggccttacacgtgcagatttggcaagagagcttgaagtgaccgaacaggctatatggcaatttgaaactggagttacacttccaaaaatgaaaaataagatagcaatggctcgtttttttcaggttgaagttgactattttgatgctgttgataagaatggttcattctcactaagtcgcattgcctttcggaatgcagaccttgaggcaaaaaaaaacatccatatccaaatggtatatttggaaaaaatgaatcaaatgatagattatttggagaactttgtatccattcctaatcaaataatttaccagttagttgatagtattgagcaaaaacttcagcaacatgaatcacttgagtttattgctgatcatgttagagaggtattggcagtatcagttgataatgccaatctcctctatagtttagaaaaatctgggatatacatttcagagagattaatcaatggaaatgcggatgcctatagtgcttggtcacgtaatggtcgaccttttatcgttttgggactgggaaaatcagcggtacgacataattttgatttagcacatgaactagggcatctactcttgcacaaccaagtagattttgaggaactgtcaaaagaagaattagaggaaaaagagaaagaagccaatcaattcgcctcctatttcctgttacctaggaaacaatttttaatggattttgtgaatattgtaggtaagcgtgtcagcaatcctgatcaatatatcttgttaaaaaaacgttttggtgtctcaattcaagcgcttgaatatagagcctacaagcttggcttactgactccacagcaaaattcttatttctatcggcagatttcaaaaaaaggatataaagcagttgagccactagatttggaaattcccttaaagaaaccaagtaaaatcagaagtatcttagatgtcatcctttcaaacaatcttttaactctgtcagatattgaacgaaatcagagggtgtcaaagaattttatcagtcaattattttcatttgatgtgaaattttttgataagtatttgcttcaattagatacgtttgataatgtaattccattgttttctagaaaacaatgatggggagtagagtaatgaacaaaatcaattcttacaaaatccacctcccctctctcctccctttcggtttccttttcgccaacaattgttacacctaccgagaggtgtttatggaggggcagtttgaggcggtggtggaggttgatgaggctggtcagctgtcgtcctatgtttgggattgtgagatggaggaggtctataccgcccatctggtgactgcgccatctggggcttttgtggggcaggtgagagaaagctatcagtccattttggatcgagtagaggaggcctgctgtatcgctctaccatttaccaaagaccaaagcaaccgcatagcccagctcattaaggagcagtggggcgaccttcctgactatccctttgccaagttgccgacctatggggcttttcgccaccccaacaataacaagtggtacgccctggtcagtcagattccgagggacaagctggatgggagcggttctcaagaagaggtggagattgtcaatctcaaggttgccggtcgggaaatagcagagctgttgagtcggtcgggcatcttccctgcctaccatatgtcgaagaagacctgggtgtcagtcttgctggatgatacggtggaggatcagacggtgtttgctctccttgagaagagccgttatctggtaggaccaaaatcctacaaggcgacgcaagggcctgattactgggttattccagccaatcccaaggtctatgatatcgataccgaatttgcagaaaataaggtagtctattggccacaaaaatcaaccattcaagtcggggacatcgttgccatttatgtcacggcacctgtacaggctattcgctatgtttgtcgagtcttgggggaaaacttggaaaatcatggagagtcagatattccaacagaaaagaaactcatgcaggtggaattgcttgctcagttttccgatgatgttttgccgagagcgcgcatgatggacctaggagtgaaagctgtccgtggacctagacgcctcacaaaggagttgatagacgttctgacatcagaagtgataaatatttattaaattatcagaatatttaataaaaatctttacatctgcaaaaaaagcggtataataagactattaaaatttaaggaggagtaggtatgaagaaaagcttcattcatcagcaagaggagatttcttttgtcaaaaatacatttacccagtatttaaaagataagctagaaatcgtagaagtgcaaggaccgatcttgagtcgtgtcggggatggtatgcaggataatttgtccggtgtggagaatgcagttaccgttaatgtgaagctgataccagatgctacttatgaagtggttcattcgcttgcaaaatggaagcgtcataccttggctcgctttggatttcacgaaggagaaggtctttttgtacatatgaaagccttgcgtccagatgaggattccttggatccgattcactcggtgtatgtggatcagtgggactgggaaaaggtcatccctgatggtcgtcggaatttagcttacttgaaagaaacagtagagcagatttacaaggctatccgtctgaccgaattggccgttgaagctcgttatgacattgagtctgttttaccaaagaaaatcacctttattcacacagaggacttggtgaagaacttcccagacttgacaccaaaagagcgtgaaaatgtggttgccaaagaatacggtgcggttttcctaatcggtattggtggagaactggcagatgggaaaccacatgatggacgtgcaccagactatgatgactggacaagcccatcagaagcaggctacaaaggactcaatggagacatcttggtttggaacgaagcacttggatcagcctttgagttgtcctcaatggggattcgtgtggatgaagaagcgctgaagcgccaggttgctattacaggtgacgaggaccgtttggaatttgattggcatcgtgctcttttgaatggtctcttcccgctttcaatcggtggcggtatcggtcaatcccgtctggccatgttcttgcttcgtaagaaacatattggtgaagtgcagtcgagtgtttggccacaagaagtgcgcgataattttgagaatattttataagagattggcttcaatctcttttcttctgctttcaatctgctatctgaaaacatttacaacaagattatctgtgatttttgcgccaatctatgatatacttttttagttaaattaaaatatatagaggatattatgacaaaacttagagaagacatccgtaacgttgccattattgcccacgttgaccacggaaaaacaaccctcgttgatgaattattgaaacaatcccaaacacttgatgaacgtacgcagttggatgagcgtgccatggactcaaatgacattgaaaaagagcgtggaatcactatccttgctaaaaacactgccgtagcttataacggtactcgtatcaacatcatggacacaccaggacacgcggacttcggtggtgaggttgagcgtatcatgaaaatggttgatggtgttgtgcttgtcgtggatgcttacgaaggaactatgccacagactcgtttcgtattgaaaaaagcccttgagcaaaacttgactccaatcgtcgttgtcaacaagattgacaagccatctgctcgtccagaagaagtagtggatgaagtgcttgagctcttcatcgaattgggtgcagatgatgaccagttggaattccctgttgtttacgcgtcagctatcaacggtacttcatctttgtctgacaatccagcagaccaagaagaaacaatggcaccaattttcgataccatcatcgagcatatccctgcaccagtggataactcagatgagcctttgcagttccaagtatcgcttttggactacaatgacttcgtaggtcgtatcggtatcggtcgtgtcttccgtggtactgttaaagttggtgaccaagttaccctttctaaactagatggcacaacgaaaaatttccgcgttacaaaactctttggtttcttcggtcttgagcgtaaagaaatccaagaagcaaaagctggtgatttgattgctgtttctggtatggaagacatcttcgttggtgaaactgtgactccgacagatgcagttgaggcacttccagttcttcgtatcgatgagccaactcttcaaatgactttcttggtgaacaactcaccgtttgcaggtcgtgaaggtaaatgggtgacatctcgcaagattgaagagcgccttttggccgagttgcaaacagacgtttctctccgtgttgaccctactgactctccagataaatggactgtttcaggtcgtggtgaattgcacttgtctatcttgattgaaaccatgcgtcgtgaaggctatgagcttcaagtatcacgtccagaagttatcatcaaggaaattgacggcgtgaaaatggagccattcgagcgcgtgcaaatcgatactccagaagaataccaaggttctgttatccaatccctatctgagcgtaagggtgatatgttggatatggttgcgacaggtaatggtcaaactcgtcttgttttccttgtgcctgcgcgtggtttgattggttattcaacagaattcctttcaatgactcgtggttacggtatcatgaaccatactttcgaccaatacttgccagttgttcaaggtgagatcggtggtcgtcaccgtggtgcccttgtttctatcgaccaaggtaaggcaacgacatactctatcatgtgtattgaagagcgtggtaccatctttgtaaacccaggtactgaagtgtacgaaggaatgattatcggtgaaaactcgcgtgaaaatgacttgacagttaacatcacaactgcaaaacaaatgaccaacgttcgttcagctaccaaagaccaaacgtctgtaattaagacaccacgtatcttgactcttgaagaatcactagaattcttgaacgatgatgaatacatggaagtaacgccagaatctatccgtcttcgtaagcaaatcttgaacaaggcagagcgtgataaggctgcgaagaagaaaaaattagcgactgaggaataatttctaggagaagaagcatgttttatttaatcctcgccatcatgttagtacttttttatatttttattgcacctagcaatattaaggggactatgaatttgattgcggcagtatttttactggtagcattagcgattgccttggtacttggatttttaagaatcatgcaatttccaaaggaaatttgggttggtctactaatgattctgattggtttttgggcgatgcgggatatttatcaattaaatgacgatacaaaattttagcagagtctttgatttttgaataccgtaatacgatattactaaggaattttatccagctttttggacagtagtggcaatctattagctaaagaaattatattctgtgatacatcttgaagaagctctcgttatttataataaatgacaagcgcattttcaaggtgtttttatgtagataaattttaatactcaatgaaatccccaaaatagcaagtttttagtacagtcatttaaattaactctgatacatcgccgctttcagcttgccgcactctacgaaagtgactcgtttcgcatgtcttatttccaacctagaacagcctctaggctgttctagctacctgcacatcggttccttgtctgaaagctaattcattagaccatacaaggcaatgagctgccgccgccaacttttatcaacatcttagcaatttgcgttttacagtctgaagctgatctctataattgacgggagtgggaaagacatccatacattaaagtaattaaagacaaattaaataactatattagtcattcaaacctaaatgagagggaattgttttataaaatattgctaacagttttcccttagacaaactcatattactagacaataaatggaaactatagtaaaataccaagtattgttattaagttgtactttaacttagttgtataatattttggtaaaagagaggaaacgcagatggatgtaaaaaatcttcggaaattaaagcgaattgagttatatgagattatgttggctcaaagtgaagagattgattgcttgagaaatcaacttgagaagattaaaacagagttggctgatagaagaattatgattagtcaatctggctccatagcggaagcttcaatgaaactgactaatatttttgaagaagcgcaaaaagctgcggatctatatctctataatgtgaaaaacaaaattggtgatgttcatgaatagttcaaatctcaagggaaaggaacttccaaaaacttcagaattaaaagagctatatcagcatgaaagatatagacatacattttggaggacagtgaaaagtacagtgtttatgttggtagtagttgcagcatttgcaatactaatcgctgtattatttttgcctattttgagaatatacggagattcaatgaaaggaaccctgaatagtggggacatcgttgtatcagtaaagagcaatgattttgaaagcagtgatgttgttgctttttattacaataacaatattctggtcaagcgcgtcatcgctgaagctggggattgggtggatatggataaacaaggaaatgtttatgtcaataatcaaagattggacgagccatatttggcaaatagggattatggtcatacagatattgagtttccctatcaggtaccggaaaatcgaatctttgtcatgggagataaccggaaagagtccattgattcgcgaaacaacgctattggtacagtctctaatgaacagattgttggaaagttggtatttaagatttggccactgtctgaattgggatggattgaataaatgaaagtgaaaaaatagaaaggaggatcttgtgagagactggttaaatttagaaaaaatccaaggttggcgacgaaagtacaagaagctcgtgaatatcattgctttcctcgtagtatttgcaacgacctatgctttgattctacccgctatcacattagaccaagaaaaggctgaataaactgctgggattgaagtgcaagaaacaccagtaacaacggaaattagtaaattaacagaaccgatggtgacaactcagcaaactccgatagtgggtagctctgctgatgaagttcaatctcctgcgacagaaacggttcctgaccctgctgagcaagtgtcaacagagtctgctagcaaaccccagaccgaccaagaacggattactgagccaactaccatagttcacaaaacgaatgattatgaggtgactgcaacatttgatgcgagtgctcaatttcccaaagatgttgagtttaatgttagagaactagatagccaatcagaagaatatcggacacattatgaaaaaaacaaggagaagcttggagtaaaaaaacttgtatatgcccgattctttgatattcatttttcatcacagggccaagaggtcgagcctgcctcccctgtgaagattacgattagaaacaaggaattagttcaacggccagatgatagtaaactgaaaattgtccactttgaagagaatagccagatagaagttttagaggccgaaacgaaggaaaatgaacaacaaatctccgagatcagttttgacgctagccatttttctgtttatggagatgttttagcaaactattatactgtcaaatttacctacactgacacagcaggtcaagaacaagtcattacgagtttgattgataagactgtggggacttcacttggtagtttgcctgaagctccttttaaaaacggttatgtattttctcattggattaataaagatactggtgatcggattgatgaaaatacggtgataactggcgacctgactgctgtagcagtatttaataatatcaatatctacaccattgatgtcacgtatttctaccacaatgtttctaaaaaccaagatattacgattgataaggaaacggtgcaactggaagcaagtgatgctccatatcaactgacaccacctgcttctactgaggtgagcaacaaagaggatacaactttaccagcagatgctatttactaccctgaaaaaccacttcttgagtttacagcagatcaactagagcgactggacgtagcagatggagtggatgataattatattagcgaaagagtacaatatgttccttacaatgcagagtatgatgtcatttataggctaaagaatttgacggggtcaggttattctgatatccagactgttcatgtccgtggggtactgggttcaactgttacaccgcaaattctaacctacaactatgctgactttgaacgtgctgatacagcaaagattgagaatactagcggccaaaaattgtatgtttattatacacggaaaacctttactctttcttataattccaatggcggtagtaatattccccaacaacagggtctatacgatagccagattaagatttctacaactactccaacaaaagaggggtatacatttgaaggttggtatgataatcctggactgactggaaacaagattacaggctctctcaccttaaagaaagatacaactttgtatgcgaaatggacaccgaacagggttcgctacatcattgggtattacaaggaagtctatgacaacaacactggaacaacctcctatgtatatgatagttcggcagctggttggggtctggttgggactactgtaaaaggaacagattcaaatattggacctcctccgccaacccaaacaaccattggcagcattggctacgagaaggatgttactaaaagtgctgcttcaagtattgaaattgcagctgatggaacatctgttttgaaagtttactataaactgaagcgctacacttttgaatttttcttaaatgataacaatgccaatatcaccataaatggtaagacctactctgataggaataggtacatgatacgtgatgttgtgcttggtcaagatgtctcaaagttatggccagcttctataacaaatcctaaagaagtatacgatgataaagtctactatgatagctatggtaggccgataagatacttttttgactactggatttttgggaatctactcttcaaaacagatcggttcgaagttgttgagtctatgttgccaacgagtggaacaaccagtaagttcacagcatattggaatacccaaggtacacaggctaacgttgaatattggttacaacaaccggatggttcttataagaagtctgatatatatagtcaatctttcctaaagactgcaggactgctaccgaaagaaatttttggatattcttattatacagatgctagttttactgaagcaggcattaggtattacggaactcaaggaaatacatatcgtttctactataaacgccaagccttcaaaattgactattattacaatagtactgggttagattcaaagagtaacattctctttgagagtaacatcaatacagcaacttataattaccaaccaccacgttctactggagttgatgctgattatacatggggtggatggtatacagattcgttattgacagagaagtataactttaataagatgcctgccaataacttggttctctatgctaagtggattgctccaaaatttaaggttacttttgatatcaacggtggtaatggaactgcccctgtcgatcaaagtgttgaaaaatacaaatacgctaaggcccctgctgatccaacgagggaacattacaatttccttggttggtctacagaagatgggaaactctatagttggagcgaccaagtaaccaaggatgtcaaattgactgcgaagtgggaattgaaaccattaacttatactgttcgctatcttgaagcaggtacaaatacgcaattggctgctgataaagtgattacgagtccagcgcttgtattgaatcaagctatcacagaaaaggcattgggaattacaggttatcgaccagataagagtagtcaaacaattaacctgaattttagagggaacgaaataactttctactatacaccgaaggtaaaagatgttgtttacaccatcaagtatgtcttgaaggataacccagctattgaggtagcacctacagttactcgtaaggttgatggaagtatcatccgtgcgaaagaagctgctgcagatgtgaataaacagcatttgcagagtcagtctggtgttactgctgaaatgctggaaatggattactatccaactgtaaatactcaaagtttgattctaacttctagtgatgcaaataatgtgattgtttttgaatatgtcggattcgatactcaaacctttacggtaaattatttggatatggatggtaagaaaatcgatggtcaagaaccattggtagtttaccgaaagaaaccaggtagtttcgtggtagatcataagactataaatggttatacctatgatcattcgttagacagtgagaatgcagctgataagacagtataccgtgtaagtaagggtggtcacataaccattgatctctattataagaaaaacctaacactgaccgcattagataagtccaaagtttatgatggcactgccctatcaagttcgggtctgtctgatttaaatccttcgtacagttcagaactgaaaacaggtgacaaattggttgccatcagctatgatggaagtcaaacaaatgctggtagtagcgcaacgacacctaaacttgctaacatcagcaatgcatctggtgctgaccggacgaatttctatcacataacctatcaaccgggtaacttaagagttgaccaacagccagttgtggttgtcatcgacggtgaaaagaaatcgaaaatctatgatggcaaagcagaagcagttggttataaggtgacggaaataagagattcaagcggtctctataaaaaaacagatatcaaatttaatggttcaagttcagagcagtcggttaagaaaaaagatgcaggaatttatccactccttttaagtaatagattctcaaataccaatcagaatttccaagtagatttcttgatttctgatggggaattaagaatagatagacggcaactgaccataacatctgactccgctagcaaggcttatgacggtagcgagcttcgtgctgacaatatcacagtctctgtacctgctggtgttgactacacaggttttgtcgatggcgaagggattataccaaccttcttaggcggtccaatcgattctggaatgatgccaaacttctttgaatatgctctaaaatctggcacgaatttagctaattatgagttagatatccagtttggccagctcaaggtcaaagaagtcatcaagattcagaaaacagacctggcctggcaggccctttcaggtggtaagtttgaattgaccaagtgggatggtttgaactgggctcaggtagatggggtgcaggaatttgccattaccagcaaagatggtattcggataccggtaggcttagaagcaggtcgctaccgtctgcaagaattggcagcacctgatggttttatcgtcttggatagctatatctacttcagcatcaaggaaatctttaacgaagataagacatcttccttctacacagtttccttgtctgatgaagcaggcaaggatgctagtccggaacgagcaacgcttaccaaggttagtggtgatgccagtcatcgcatccaagtggccaatgagcagggcagagccttgccaagcacaggcggagatggacagaagtggtttattctttctggccttgtcctcatagccatctcctatctgatgcatctgtttgttcaacgtcgaaggtaaaggagacagtaacaatctccaaatcccttagtagtaaatcgtctcagctttctaagtaacgtccagtttcttagacctaatccaaataaataaaagaaggaatattatgaaaaaattacaacaattctttacatcccttgtggcagtactgacagtcttcgcttttggttccacggccttggcgcaaactgttgatagcggaaaaagtggagcaggcactattactgtctctaacgcttcacaaggtcaaacttacactgcctataaactctttgatgcaactgtaaccacagatggttctggtatctcatacaaacttcctgctggtaaaactgcaacgaactttggtggtgatacttggttcgaagtggacagcaaaggtaatattactgcaaaggaaggtgctactgtctcttcagaagcatttgcggcttgggcaaagaatttcggtacagaagttacaagtgctacagcgaatgataactctcttgtgtttacacatttgacatttggttactattttgtaacatcatcacttggtgcagtgcttacagtagatagtacaacaccaaatgcaactgttatcgataaaaacactactaatccaaccattccagattcaaataatggtggcggtaagaaaattcttagcaatggtgctacaactagtgaaacaactgcaaaaattggcgataccatcaacttccaaatcaagtttaatgctaccaactacgttactaaagatagacaaaccaagcagattgtttcttacactatcgaagatagcccaacagccctcgcaattgatcaaaattctgtcaacgttaaagtggatggtgtggatatcacagcaaaaatttcgaagacttttgatgcaacaggcaaaatgaatcttgtcattacatgggcggatgcggcagctagtaataaaaccatctataactctccagctgaagttattatcacctactcagcagtggtgactaaagatgccaaggagggagaagcaaccaactcagcgactattggttacaacacaattgataatccaacaactcctccaacaccagttgatccagacaagccaactgaaacaacaaaagtgactactcaccgtttcactttgaaaaaaacaaacaatgtaggtgaaactttgacaggtgcagagttcaaactctatgatgcagccaacaatggaactgaaatcaaggttgtcaaggaatctgacggagtgtatcgtgttgcgcaggctgatgagcaaggtgttgtcatcgaagctggcgaagttgtgattaaaggtctgaaacatagcacgacctattatcttgaagaaatgaaagcaccgaatggttacaatatcttgacagaacgtcaatccattgaagtgaaagagaataacacagcacaagcaaatatcgtcaataaaaagggtggtgtcttgccaagcactggtgcgattggaacaactttattctatctagttggttcaatcctacttttggtagcattggtttatactatttcaaaacgtcgtatgaacaatatctaattgtccatacaatacctaatatttagaatctatcttcggaagtgcaaaagcaagagtggaagtatttccgaagatatttctttggtcttaacacaaggaaaggaggggatttcatgatcaaatggctcaaaaagaaaggtccgtcttttatcatgccattaatttttatattggggattggactattggcttatccatcggtcagtgattactggaattccttccaccaatcagaggccatcatgtcctattctgacacagtatcagatatgacagctgaccaatacaaagaaatcattgatagtgcgcgccagtataatcaagaaaaacccttaaactggaatgtgactgcatccgacattgaagcctacaatcaggaattgaatttcaataaagatggcatcatgggctatattgagattcctaaaattgatgtcaagttatctatatttcatgggacagacgaaacggttttagagacttctattggacatctagaaggaacatcgttgcctgtaggaggtttgggaactcatagtgtactttcagggcatcgtgggctcccatctgcccgtctgttttctgatttagataagttgagagaaggcgatatatttaccattcacgttctcaatgaaacactaacttacaaagtggaccagattcgagtggttgagccatcagatttatcggctcttaccatggaacctcagaaagacttattgactttggtaacctgtacaccctacggtattaatacacataggctattagttcgtggctatcgtattgaaaatgttaatggtagtgctttggttacctctgatgctatccaaattaaagcaatttttattgctccatttatcgcaactccaattctatttgtaatcttaatttatatttttataacaactagtaaaacatttcgttctcggaataggaatcaagtgttggatgattttttagttcccaagaaattttgaactattgaaaatgtttcaaagtcgatttgactctggaacatttttctattatagacattagacaatatggctgaatgaggtaattgttcaacttctaacctcctgtcaactcaaatcaattgcctagaccgacgattgaaacgacttctttctagtaactgaccgcaagggaagaggtggcagatggtgtagaaatggcgctgtgatgtcatacctagttcagcttgtaacaaaagtaagacaaggattgattcatctgaaactttaactaagccaacatttcgccgatatttgaaggaatccgggcaatagttgttgtagaagtgatgacaaatttgtgataattggcgtacattccattgcaaatgatgagatttagcagtatactgtaagtagctcatttggactacccctctgtatgtttcgtcgcttacagtatagtccatttgggctttttattgtattttgaaatgaactagcgctacgggcagagtttacttttctgtcctctggcttgaaaaaggtcttcgtaaagggtaaaataaggtgttagaaagtaaaggtatttgagatgaagatgattgatattgtaaaaaataagaaagtgttagtgctaggtttagctaaatcaggggaatctgcagcccgtctactagataaattgggtgctatcgtcactgttaacgatggaaagccttttgaagaaaatccgactgctcaatctttgttggaagatggtatccgtgttatttgcgggagccatcccttggaattattggatgaagatttcgctttgatggtaaaaaatccaggaattcgctatgataatcctatggttgaaaaagcaattggcaaaggaattccagtatggacagaggttgaattggcctacttggtatcagatgttccaatcgtggggataacaggttcgaatggcaagacaacgacaacgaccatgattgcagaagtcttgaatgcaggaaaaaaacctgcaaaattatgtggaaatattggctatccagcatcttcggtcgctcaaactgcgactgcagaggataccttggtgatggaattatcgtctttccagttaatggggacagaatctttccatccgcatatcgccgttgtgaccaacctcattgccagtcatattgattatcacgggacttttgaagactacgtagcagctaaatggatgattcagcgtcagatgacggctgaggattttgtggtgatcaacttcaaccagaaagaggctaaggaattggctggacagaccaaggcaacggttgttccattttcaacacaggaagtagttgatggagcttatttggcagatggaaaactctatttcaagggtgaatacatcatggatgctgaccaaattggtgttccaggttcacacaatgttgaaaatgccttggcaacaattgtggttgcaaaattgttgggagtagatcagcaagcgattcaggaaagtttgtctgcctttggaggtgtcaaacaccgcttgcaatttgtaggtgaaatcaacggggtttccttctacaatgatagtaagtctaccaatatcttggcgactcaaaaagctctttcagggtttgacaatagcaaggtcattttgattgcagggggcttggaccgtggcaatgaatttgatgaattagtacctgatttggtcggactaaagaaaatggtgatccttggtcaatcagctccccgtgttcaacgtgctgcagataaggcagaagtggaaacgatagaagctctcgatattgcggatgcgactagaaaagcctttgccattgcggaaaaaggagatattgtccttttaagtccagccaatgcaagctgggatatgtatgccaattttgaagtgcgtggcgacgtcttcttacagacctttgaggagttgaaataatcatgaaaaaaattgtttttacaggcggagggactgttgggcacgtgacgctcaatctccttttgattccgcgatttttggaagaaggctgggaagtccactatattggtgatgggaacggtattgagcatgagcaggttgtgaaatcaggtttagatgttcatttccattcgattgcgaccgggaaattgcgccgttatttctcttttcaaaatatgttggacgtgtttaaagttggttttggtgttcttcaatccttgaccattattgctaaaattcgtccgcaagctcttttttcaaaaggtgggtttgtatcggttccgccagttattgctgctaatttgctgcgggttccggtctttatccatgaatcagacttaacaatgggactggccaataaaatagcctataaatttgcgactaccatgtatagtacttttgagcaacctgccagcttgactaaagtaaaacatgttggtgcggttacaaaagtggggcaaacgaatgacaaagttacaccaattcagttgccagaaattctcagtcacttcgataaaagtctgccgaccctactgtttgtaggtggttcgggcggtgctaaggtctttaatgatttaatcagtcagaatagtgctgccctgaccgaacgattcaatattatcaacttgacgggggacagtagtctcaacaaattagataaaaacctatatagagttgactatgtaacagaactttatcaaccgttgatggatttagcggatgtcgttattacccgtggtggttccaatactctgtttgagttgattgccatgcaacaactccatttgattgtgcctctaggacgacaggccagtcgaggagatcagattgaaaatgctctctatgcagagaaaaagggatattctaagcagattgatgaaagtcaattgacatttgccagcctgttagtagaagtcgatgagctattgaaacataaggaattttatgtccaaaacatggcaaattctaatgaaattcagtcagtagatagtttttacaatttgcttagagaagatatgggaaggtaggttctatgacggaaaaagattcaaatgtagaagaatcagtgctagaagtggaacaggcatcccaagtagaattggattccgaacaaatttcaccagcagagaaagaatctgtattagccgaagagaaagaattttctacggatgtagacatacctgagatgactgctccggatgatgaaaaaagtgcctttttcgaacaatggaaagcacgccaccaagcctaccttgctcataaagatgaggcagatattcaggcagttgacgagggacagacagaacaggagatcccagaagctaaaaagagtaaaagggtcctttttcagggaatagaaagaaaaacagagagtctgaaatctaaaaaggaaacaggggaaaaggttcaaactttaaaagttgatattccttccaaagtagtctggaaagctattccggttcttgtgacgagtttgttactggcagctctagccttgtattttatttctccaaccagcaagaaaaaacaaatagaggttgtcggaaatgagcgactaactgctgagcaagtagaaaattatagccttatctctccggatgattacaatgtgactatagctttgcatgcagatgcttacgcaaagaatattaagaagaatagttcgtccgttgagacagcgacaatcaagttccagtttccagctacctttaccattcacatcaaagaatacgcaataataggctacattcagcaacaaagtcagtggtatccagtattgtctagtggagagattggcggtgaaccgatttcacaggattccttgccagaagactatacaacaatcaatttatccgacaaggaattaatcaaggaactggccattgaattgggtaaaatagatgcaggaattcgttctgctattcagacaataaatttaacgccaagtaaagtgaccgcggatttgctgacattcaatatgagagatggaaatactgtattagtcccgttgagtgagattagccagaaggtgtcctactatacaaaaatagcagcagaagtgactgttccaacaacaattgatatggaagttggtatttatagatatgcaagctgaaatagataattttgtaaagaaaaagtaataaaaaaatcctttaaaaacaccataattcgatataatatggtataatgaatgatgactaattatactatttttcaaaatggaagatgatttgttaaagttggaagtaagagaggactgatagaatggctagaaacggcttttttacgggattagatattggtacaagctccgttaaagtcttggttgcagaatatattgataacgaaatgaatgtgattggggtcagcaatgtaaaaagtgctggcgtcaaagatggaattattgtaaatattgaggtggctgctggagcgattaaaaaagcgatcgagcaggcagaagaaaagtcaggtatccgcattgaaaaggtaaatgttggattacctgccaaccttcttcagattgaaccgactcaagggatgattcctgttacaacagattcacaagaaattacagacttggatgttgagaatgttgtaaaatcagcattgacaaagagtatgactccggaacgcgaagtgatttcatttattccagaagagttcactgtcgatggattccaaggcattaaggaccctcgtggaatgatgggaattcgcttggaaatgcgtggtatgctgtatacaggcccacgtaccattcttcacaatcttcgtaaaacggtggagcgtgcaggtgtccaagttgaaaatattgtaatttctccgttggcactaactcgctctgtattgaatgaaggtgaacgtgagtttggtgcgactgtcattgatcttggtggcggtcaaacgactgtggctgttatgcgtggccaagagttgcaatatacaaacatctaccaagaaggtggagattatatcacaaacgatatttcaaaagtattgacaacttcaaagagtattgctgaaaacttgaaatacaactacggcattgcctatccgcaagatgcaagtgataaggaaaaatttactgtcgaagtgattggagaaaacgctccagttgaagtgaccgagcgctacctttcagaagtgattgcggcacgtctgcgtcagatttttgaccgtgtgaaacaagatttggagcgtacacgtgctctagatttaccaggaggcattgttcttgtaggtggtggtgctatcttaccaggaattatagaattggcccaagaagtgtttggtgttaacactaagctttttgttccaaatcaaattggtatccgcaatccagcatttgcaagtgtgattagctttgttgagtatgttggtgagttagaagatgtagaaaatattgcccaacatgcagtaaatggtgaaactaccttgagacataagccagttgaaattcctgttgctcgtcctcggattagtcagccaattcaaagagaaatcgtgaacgaattgaacacagttgatcaggtagaggaacaagttgctcctacttaccatgatgaggaagaagaagttcgtccagctgctaagggaaacatcacagatcgcattcgtggtttatttggcagcatgtttgaataagagaaaagaaaaggtgatttaaactatggcattttcatttgaagcagcagctagtcatggtgctgtcattaaagtaatcggtgtcggcggtggtggcgggaacgcaatcaaccgtatgattgaagaaggtgttgctggggttgagtttattgcagcaaacacagatgtacaagcgctaagtagctctaaagctgaaacagttatccaactaggtcctaaattgactcgtggtttgggtgctggaggtcaacctgaggttggtcgtaaagctgctgaggaaagcgaagaagcattgactaatgtattaactggtgcagatatggtcttcatcactgctggtatgggcggtggctcagggactggtgcggctcctgttattgcacgtattgctaaaaacttgggtgcgttgactgtcgcagttgtgactcgtccgtttggttttgaaggaaataaacgtggaaactttgcgattgagggaattgaaggtcttcgcgaacaagtagatacacttttaattatttcaaacaacaaccttcttgaaattgttgataagaaaacaccgcttttagaagcactaagcgaagctgataatgttcttcgtcaaggtgttcaaggaattacagacttgattacaaatcctggtttgattaacttggactttgcagatgtgaagacagttatggaaaacaaaggaaacgccttgatgggtatcggtatcggtactggtgaggaccgagtgattgaggcggctcgtaaagcgatttattctcctcttcttgaaacaacaattgatggtgcagaggatgtcattgtcaatgttacaggtggctatgacatgactctgacagaagcagaagatgcttcagaaatcgttaatcaggctgcgggtcaaggtgttaacatttggttgggtacatctattgatgaaacaatgaaagatgagattcgtgtgaccgttgtggctacgggcgttcgtcaagatactgctgataaaccagcccgccatcgtacggaagctgtttcaccacgcccttctcaccgctttgatcattcagtagcatcagcaccaactcgtggagctgcacaacaaactgaagcgccgaaagcttctgccttcggagagtgggatttgcgtcgtgaaaacttgattcgtccaactgacacagaaccaacatccactgtttcagtcgaaaaatttacaatggatcaagatgaggatgaattggatacaccaccattcttccgtaatcgctaaactaaaatgaattttcaaaagaataaggatgctatcttttcagcagttgcaaaagctgctgagaaggcaggtcgtccaagtgaatcagtaaaggtaatagctgtcaccaaatatgttgacagctctattgctaatcagctagtgaatactggaattactcatattggagaaaatcgagtcgatcagttcttagaaaagtataatgccctagcagacaaacaattgacatggcatttgatagggactttacagagaagaaaggtcaaggacattattccatttgttgattatttccacgccctagactctgtcaaactagctcaggaaatagataaacgtgcgactaaaatagtcaagtgtttcctccaagtcaacgtttccggtgaggagagtaagcatggctttgcagtatctgagattgatgcggcacttgctgaaattagtttattggagaacattgaacttgttggattgatgacgatggcaccgattgatgctacagatgatgaattagacgagatcttttctaaaatgcaggaaatccaagaagaactagctacaaggaacttaccacgtatgccctttacagagttaagtatgggaatgagtggggactttgaacgcgccattgctcacggagctacatatgtgagaattggctcagcattctttgaataatggagaggaggaaaatatggcattaaaagatacatttaagaacttatttaattactttgaagttgacgaagtcaatgaagttgaagaacaggcagatgcctattcaatgcctaatgatcgtcctaaaatgcgtgttgccaatactacagttgcacctgtgcgcgaacagcagccaaaagtagagacgcgtcgggaagcacgttcagaaagtcaacttcaacgcctacatgaaaggcagcaagaattgatgactaataataacgaaaaagagattgtcaaaactacaattgatattaagtttccaaaacgttatgaagatgcaccagagatggtaaatcttttattagacaatgcgagtattctcattgattttcaatatatgtcggagcaacaagcaagacgttgcctagactacttggatggtgctcgttcagtattatctggaaatttgaaaaaggtctcaaataccatgtggctgttaactccagtaaatgtcacagtcaatattgaagaattgcgcaatgctggtacaactactggtgtggctgattcaaattttgaatttgatataaaacggtaacgctatgcaaattttgatttttttactattaaaaattgtagaaatttattcttatctcttattggcatacgctttgctaagttggtttcctagcctatacacaagctcgattggtcgtttgattcaatggctggtagcaccgattttaaaaccctttaggcggttaaatctgcagtttatggggttggattggaccgtaatggcagccatgattgcgcttaatatgggaacacgcttcttggttcaattattgctcctgttagcatagttatgaaaaatgacaaaaacttattgcaacatttttctagggaagaaagagagtttgtagagaaaataatggatatgtgtcagcaagttgaagatacgtattcatacagattaactcactttttacatcctagacaagatgaaattgtatgcaaaattgctaactactaccagttacaaacgttttctagtcgtgaccttgtttcgacagaacattcgcgggttattattgccccgacttattatgagttggacatcaaggactttgagttaaccgctcttcatttgtcctatgctagaaaatttcacaccttatcccattcacaagttcttggaacttttctcaatcaactagggattaaaagggagtatttgggtgatattttgattgatgatgaacgattgattgtctttatcgatcagaaatttgggcagattgccttacaatctatcactaaagttgctcgtgtccctgttaagggaaaggaagaagaatggacgactgttcgactaccgattggacaggaatggcgttcaaaggatgtgttggtttctagtatgagattggataaattgatttcggtcgcatttaatctttcaagggcaactgcaaacaagttgattgaggctggacatgtgaagttggattatgttctgacagaacaaaccagtaaattagttgaaatagggcaattaattagtgttaggagatatggtagagttcgcctaaatgaatttttaggtttttctaagcaagggaagataaaattaaagttagacattgttaaaacttaggaggaaagatggcacttacagcattagaattaaaagataaaacctttgctacaaaatttagaggatacgacgcagatgaagttgatgactttttggacattgtaacacgtgattatgaggatttaattcgtaaaaatcatgaccaagagttagaattgaaaaatttgcgagaacgtttggcttattttgatgagatgaaagaatcattgagtaaatcagttcttttagctcaagatacagctgagaaagtaaaggttgcggctgaagatcaagcggcaaatattattaaacaagctgactatgatgcggcaacattgttacatgaagctaaagataaggcaaatgaaattcttcgtaatgcgactgacaacgcgaaaaaagttgtcattgaaactgaagaattaaaaaaccagacacgtattttccatcagcgtctaaaatcaacagtagaaagccaattatcactggttaattcatctgaatgggaggaaatcctccgcccaacagcaagttacattcaaacaagtgacgaagcctttcgtgatgttcttcataaggctttggatgaagaattacctgttgaagaagaaagtttggattatacacgtcaattgacaccagaagagattgcagaattaactcgtcaggcagcagcttttgagagtggagaatctgtagtactttcaatagaagaataatagaaatcataagcaaagacaaggtcgttagaaatattttaagcgagtaggagatggtggaagccctacaatctctttctatggatcatcactttgtttgatctttcctgaaaatagtaaggagagacgtccgttcacgttacgaacatagagggatagaggaaactctatctaaactaaggtggtaccacgaactttcgtccttatttggcgggagttttttatttttatgatacgattagaattagtaaacaaggataactttgaagtagtgttacaagttcaacttgcatctgaggaccaacgccgagtggcatcggttgaatattctttagcccaagcttggttatataaagattcggggatgattctaccatatgctgtggtatctggcagaaaagttgttggttttgcaatgttatctattgaacccaaagataatagttattatttatggcgcttgttgattgataaggattttcaaaatcgtggatgcggaaaagaagccatccagcaaataattggaaaggcgaaggcggatccgctttgtcataaaatttcgataaattatgtcattggcaatcataaaatgcggtacattttagaaaaaattggttttcaatccgttggtttagaaggccaagaaatgaaaatggaattaattataaaataaaggagttatgatgaaactaaaagaaacactcaatttaggtaagacagcatttcctatgcgtgcaggcttaccaacacgtgagccagaatggcaaaaggcctgggatgaagcaaacttgtatgctcgtcgccaagaactcaatgaaggcaaaccagccttccacctccacgatggccctccatatgctaacggaaatatccacgttggacatgctttaaacaagatttctaaagatattatcgttcgctctaagtcaatgtctggtttccgtgctccatttgtaccgggttgggatacacacggccttcctattgagcaagtcttggcaaaacaaggtgtcaaacgcaaggaaatggacttggttgaataccttgaaatgtgtcgtgactacgcttttagccaggttgacaagcaacgtgatgattttaaacgcttgggtgtttctgcagactgggaaaatccatatatcactttgacaaaagactacgaagcagctcagatccgtgtcttcggtgctatggcagacaagggctatatctaccgcggtgctaagcctgtctactggtcatggtcatctgaatctgcccttgcagaagctgaaatcgaataccatgacattgactcaacatctctgtattatgccaataaggtcaaagatggcaaggggctcttggatacagacagctacatcgttgtctggacaaccactccatttacagtaacggcttctcgcggtttgacaatgggagcagacattgactatgtcttggttcaacctgctggctctgaccgtaagtatgtcttggcagaagccttggttgatagcttggcagccaaattcggttgggaatccttcgaagtgatttcaaaacacaagggtgctgaatttgaatatatcgtgaccgaacacccatgggatagagaagtggatgaattggtcatcttgggtgaccatgttacaacggactcaggtactggtatcgtccatacggctccaggctttggtgaggatgactacaatgtcggtgtcaaatatgacttggaggttgcggtaactgtcaacgaacgtggcttgatgaatgaagctgcgggtcctgattttgaagggcaattctatgacaaggttgtgccaacggttaaggaaaaattgggtgacttgcttcttgctagtgaagtgatcaatcactcctacccatttgactggagaaccaagaagccaatcatctggcgtgcagtgccacagtggtttgcctctgtttctaaattccgtcaggaaatcttggaccaaatcgaagcaacaactttcaatccatcttggggtaaaacgcgtctttacaacatgatccgtgaccgtggtgactgggttatctctcgtcagcgtgcttggggtgtgccgcttccaatcttctatgctgaagatggcacagctattatgaccaaggaagtaacagaccatgtagcagctctctttgaggaacatggttctatcatctggtggaaatctgatgcaaaagatcttttaccagctggtttcactcacccaggttcaccaaatggcgaatttaccaaagaaacagacatcatggacgtatggtttgactctggttcatcttggaatggtgtcatgaatgcccgtgaaaaccttgcctacccagctgatctctaccttgaaggttcagaccaataccgtggttggtttaactcatccttgattacctctgttgctgtaaatggtcatgcgccatataaagctatcttgtcacaaggttttgtccttgatggtaatgggatgaagatgtctaaatctctaggcaataccattctaccaagtgatgttgagaaacaatttggtgcagaaatcttacgtctgtgggtgacatccgttgatacttcaaacgatgtccgtgtgtctatggatattcttggacaggtttctgaaacctaccgtaaaatccgtaatacccttcgcttcttgattgccaacacttcggatttcaatcctgcaagtgatgcggtggcatacgaagagcttcgttctgttgaccagtatctcttggtgaaattcaataaattggtagttcaaatccgtgaagcctacgacaattatgatttcatgggcatctacaaatctgtagtaaactttgtaacccttgatttgtcagccttctacctcgattttgccaaagatgtcgtctacattgatggtgctaaatcactttctcgtcgtcagatgcaaactgtcttctatgacatcttggtgaaaattaccaagctcttgacgccaatcttaccacatacggcagaagaaatctggtcttacttggaacacgaagcagaagaatttgttcagttggcggaaatgccagaggtggaaacctttgctaatgaagcgcagcttttagctgattgggaaaactttatggtcttccgtactcaggcacaaaaagccttggaagaagcacgcaatgccaaagtgattggtaagtcacttgaagctcatttgactgcctatgtctcagctgaaaccaagtccttcttggagagcttgaatgcagaccttgctcagttgctcatcgtttcaaacttgacagtaacaactgaaactgccccatcaacagcgcttgtggttgatgaagttgcctttgctgtagaacgtgcagccggtgaagtatgtgaccgttgccgccgtattgatactagtgttgcagagcgcagctatggcgcaacaatctgtgaccactgtgcaagcgtagtggaagaaaactttgctgaagcagtagctcaaggttttgaagcctaagcaatcacaatacatttgttaaagtctatctagcgataggctttttttgtaatacttttcgaaaatcaaaattattcgttgtcaagagccttgatgaactccagttctatcttcggcttcgtttcctaggctacttttgattttcattgagtataaatagaaaaaaagaagccatctggcttcttacagaacgtagacaaactccaaaaatataaaaaattgaagaggtttgcgaaagatagcaagtgattaaactcttagaaacattgatatttcagcgtttctgagagttttttattttcaacataaagaaaaaagattgaagacaattgtccaaaatggaccttttcttcaatctgaaagaagccagatggcttcttacacttctgcgataatgggaatagacatttcaatcaaacggtctgtgtgaatcgtttgaatggcagccttgttaatagttcgttcatcaattttccgatgaaggaagaaatcacgaatttgctcgatttcattttgttgtactgcacggtatttattactaatcaagagttcataatgacggggtgcctgtgtgaaaataacgtctgtattacctgcagaataagtctctactaggaaagcatcagtattagccaactggctttggacaagattgggatgactatttgtcgtgttaatgattttcatgtggaacctcctctatctctttggctacattatagcacgattagagtgtttttactagttattgaatgaattttcttgcaatttccattgttcaatgccccatttgtgactaccacgtttgagtttatcgatggcttcattgactgggaaccaagcaatatggttgaaatcttctagtggttgtcctatttgatggtagctagttacttcatagatgtaggctggattatagaaatgggtatcgcggtggctagagtagaagtattcgtcagcctgaccaaagtattttccgatttcagcggtgaatccaagctcttccatcaattcgcgctccaaagcaatgaggtgattttctcccttttcaatttctccaccaggaagaaaccaagctccgtttggtgcttgaacgagtatgatctgttctttcttttcatctgggataactgcgtaaacaccaaagcgactctggtagctgacgccagccttcttttctccaaatacagcaattttctccataggcaattctatcctctttcattattggaatgagttgtatacattataccacttttttattatttttccttgtgataggctttacaaagtaaagtttttttataggatggagatggggaagaatttagaaaaatagagtagcaaaacagtaaaataggctactcgtagagagcagctctattttcttattttgtctttgtttgtgccttgatttgaattgtacctttacttgacatgacagcacgtaggtctttttctgctggatgttctaagtagaagtcggtgatagcatcttcaatctgatcttggatggttctgcgtagtggacgagctcccatctttggattgtagccaaggtccactaatttctccttaactttatctgttacatggaggctgatgccattgtgagaaaggcgtttgtttacatcgtctagcatgaggctgacgatttcaagtaggttttccttgctcagtggttggaactcaataataccgtcaaatcggttcataaattcaggtgtgaagaaattgctaagttggccaaggactgattgagtccgcccttccatagccgcaccaaaaccgacacttgcttcaacttttccagtaccagcatttgatgtcatgatgataatggtatctttgaagctgactgtccgaccttgtccatctgtcagacgcccatcatctaagacctgaaggaacatgtgcatgacatctgggtgggctttttcaacttcgtcaaggaggatgagtgagtaaggattacgacgaactttttcagtcaattgtccagcctcctcatagcctacatagcctggaggagctccgacgagtttagcgacagcgtgtttttccatgtattcggacatgtcgaagcggatcatgctgtcagccgaaccgaagagttcgatagctaattgcttagacaattcggttttaccgacacctgttggtccgacaaagaggaaggaaccaatgggacgatttggagcaccgagaccgacacgattacggcggatggctttagctatcttgtcaactgcttcatcttgtccgataacatgggcttttaagtcactagcgaggctcacaagctgggactgttccttttcttttaaatcaccaactgggatatttgttttttgctcaacgatggcttcaatttctttttcagtaatgagtggaatatcttcttcgctgatagttgccttttgcatctccttgtacttagcaatttggtcacggaaataggctgctttttcatagtcctcatcccgtgtagcttgtgctttacgattttcggaatcaatcaggcgttggtcaatttcctttggatcaataaagttgagggtcaaattcatttttgaaccagcttcatccagaaggtcaatagccttgtctggtaggaaacggtcttgaatgtagcgattggacagtactgcggcagcttcgatagcagcatcggagtatttaacatgatggtaatcctggtatttattttggatacctttgaggatggtaatggtttcttcgacacttggttcttcaacttttacaggttgcatacggcgttctagggcggcatctttttcgataatacggtactcgttgagcgttgttgcaccgactagttgcatttcaccacgtgcgagggctggtttgaggatattgcctgcatccatgttaccatcgcctgcagagccagcaccgacaatttcgtgaatctcgtcaataaaaagaatgatttcgcgacgattacggatttcttccatgagtttttgcatgcgttcttcaaattgtccacggatacctgttccttgtacgaggctgacaacatccagacgaatgacttccttgtctcgtaatttttgtgggacatcgccatcgataattttttgagccaagccttcaacaaccgctgttttacctaccccaggctcaccgataagaacaggattgttttttgtacgacggttgagaatttcgatgacacgggtaatttcttgatcgcgaccgattactggatcaatatccccacgacgggcaatttcggtaacgttgataccaaattcttcaaggagcccatttggttgttggggttgttgcggaggaggggtctgtccaccacgtccattatgcccaccggcttgagtgggaggagtctgttcgcgattttttccagcaggggtattgccaggatagccacctaggtgattgaaaaattcactaaagggatccatattgttaggatttgttaaatctcccaacccacgtaggatagcattatgagggtctgttttcatgatttggtagcagttgtgacagaggtctacctgctgctgtttaccgtttaagttggtgtagagatggatcgttgcgtcgttgatattacaatttttgcagagcataattctacctctttctgtgaaaaaatgtgacctattgttaaatagtcaaaaaaggtcagttctagctttattataacaagattcatagaaaaatcaagaaactgctacgcttggaaaaactttctatgaaaaatagggcgataggaagaaaatagggaaaaaataagacttttttggtaatatgtggtaaaatattcctataaaaaggattaggagaacgaatatggaatcacatttggtgagaattatcaatcgtctggaggctatggctaatgacggcggtacgttgaaacgtaatttcgaacgtgatggtattgttgttgcagaagtggcttatagctatgacgaggaaaatggttcagtatttaccttgcgtgatgttgctgctcgtgaaacgtacgcgtttgacagcatcgacttgattgcaatggaaatctatgagctattgtactaagaagaagtgagaggcacctaagggtgcttttttcttgtgtaaattgaatattataaacaaaagtattgcataaatattcaaaaatggtataatagactctaaatgacagaattggagtaagatgaatgaatttttcttttttgcctgagtattgggcttattttaattatggggcaattgttaccctcattattgcatttttctcagtattttttggtagtattttaggtgtgttgcttgcctttgctcagcgtagtaagtataaagttttagcttggactgccaatatctatgtctggattttccgtgggacaccgatgattgtccagattatgattgcttttgcgatgacacattttgtagcaccaacttttcagctaggaattttgacggttgatttgacgcgcttgattccaggtatcattgttatttcgatgaactcgggtgcctatgtatctgaaactgttcgtgcaggtattaatgctgtaccaaaaggacagctggaagcagcttattcgcttggtattagaccaaagcaggcgatgcgttacgttatcatgccacaggctatcaagaatattcttccagccttgggaaatgaatttgtgactattgttaaggatagttcacttttgtcaaccatcggtgtgatggaattatggaacggtgctcagacagttcaatccacttcttatattcctttaacaccacttgtatttgcagcgagctattatctaattatgacaacggtgctaacagtgattattcagtcgtttgagaaaaagttgaacaagggagggcagttccatgtctaatgcgattatttctatcaaggatttacataagtacttcggaaagaatgaggttctaaaaggaattgatttagatattcaacaaggtcaggtggtcgttattatcggtccatcagggtcagggaaatcgactttcttacgtacaatgaacctcttagaagtgccaaccaagggaactgttacatttgaaggtgttgatattactgacaagtcaaatgatattttcaagatgcgtgaaaagatgggaatggtttttcaacagttcaatctttttccgaatatgacggtattagataacattactttatcacctattaagacaaagggaattgcaaaggatgaggctgagaagaaggctaaggaattacttgaaaaggtaggattgccagataaggcaaatgcctatccacaaagtctttcaggtggtcagcaacaacggatcgctattgcacgtggtctggccatggacccagatgtcctactttttgatgaaccgacctctgcactagaccctgaaatggttggtgaagttcttgctgtaatgcaggatttggccaagtcagggatgaccatggttatcgtgactcatgagatgggatttgcgcgtgaggtagctgacagggttatctttatggatggcggtgtcatcgtggaggatggaacgcctgaagaagtctttgaacataccaaggaagaacggaccaaggatttcttgtctaaggtcttgtaataaatgaacaaataagtacgactccgatattgttcggagttttttgctatatgctatattctactttgtacaagtatagtcagtcggagaattttagggtataatagaaaaaacaaaaggagtgtaggtatgacagtcattgatgggaaagcactaggtgtaaaattgcaggctgctttggcggagaaaactgctcgattaaaagaagaaaaggggttggtaccaggtcttgtagttattttagttggcgaaaatcctgctagtcaggtttatgtacggaataaggagcggtcagctctagctgctggattcaagagtgaggttgttcgcgttccagatacgatttctgagtcagacttgttggatttgattgagcgctataatcaggatgatgaatggcatggtattttggtgcaattgcccttaccagcccacatcagcgaggagaaggtcttgttggccattgacccagataaggatgtggatggttttcatccgactaacatggggaaattctggtcaggtcatcctgttatgattccatctaccccagcaggaattatggaaatgttcaaagaatatcagattgagctggaagggaagtctgctttagttattggtcgttctaatattgttggtaaaccgatggcacagctgttattggatgccgatgctactgtaacgattgcgcattctcgcaccaaaaacttgccagatcttgctcgtcaggccgatattcttgttgttgccattggtcgtggtcattttgtgaccaaggaatttgttaagctaggtgccgtggtgattgatgttggtatgaatcgtgatgaaaatggcaagctaatcggtgatgtcaaatacgatgaggtatcagaagtggcaagttatattaccccggttccaggtggtgttggtccgatgactattaccatgttgatggaacagacctatgaagcttgtgtcagaagtgcaaaataagatagagagtttaataaaaataaatatatccatgcctgctttggtaaagccctgttcttagaacctgtatttacaagcgaagtactcatattaagagacagatttagctaatcaaggtaatttttttgggggatattgattgtattttgaaaaaaactaatgatgagtagcttaaaaactagccttagaatagaagcgttgaactgtgaatacaggttcttaaattatgcttgtagttttggtagctaacagtaatgagtgcagtccccgtatgaataagtctatttttaaacgactctacttattttattagtcatattcaataaatcagttttaagacggatgtgacttttagtaatattggttatactatacccaatcctaaatatttttcataatctcctgaaaagcctgatcgtgtgatcaggtttttttgtatgcaaaaatggatctgtacaaaaaaacagtactatttctcaaagtttgaacaacatcccagtgtagtaaaaacgtttggagacagattgtttcagctcaacaactgggaataaagatttattgccgaactcttttatactcttcgaaaatcaaaatcagacgttgttgacttgatttgatgaacttcagttctatctgcatctgcgtcgcctagtctgattttcattgagtattatctgtttagttctttctctctttcattttgtgtttataatgttttaggtgattgtgggacgttttcagtgaaactgctaatggaacggttttactcctagccttatctgagtaataataggataaaactcatatacccacataagagtgatagaggtttgtgaatagtatttagttagaaacatttgttatcaaatacaggttctacgttatatttaaagaacttctctatcattcgttaaatatttcttctccgatttatcgctagataggagcagtgtatgcgtttctaaaaatctaaagttggaggatgttcaattttaaataagttacaatctgcaaatcactactaaaatcaatttatcccttatacagggtaatgtaataaattgttttttctttgtttttcgtatgttttttcaaaaaaatatatgaaacaaatgaggggaatctagtgatgcactagctatgaaaaaaatatttatattaatggaattgtttgagaaatcagaaggatgtagtttttcgatttgcatacatattttaacttaaacatatgtgtgcaaaaagttctgatttttttgtgttttttaagaaattggcattgttgacaaactaaggattggtttggtatcacgtacaggctaatttgatcatattatattcacaaaaatgtatatgttttgattgataggtgatatgttagaagtaaataagcatatattttgtagcgaaagcaatataagcaaaaaggagagaggaagaagcaatgttaaatgcaaaagaccttagaaaaactgaagcgttctgaattatttgaactcttggttgagcaggcaaaggaaatagagtcttatcaagcaaaattagtagatttggaaaaaagaattgagtatcgcgaagcggttttgggagaaattggttcgatagcggaggcgtctctagcagttactaggatttttgaagaagcacaattggctgcaaatatttatcttgaacaagttcaaaaagttacacataaacaatctgataattgtgaaatagggagaacagatgaggatggcgactaataaaaataaggattatgttaccatatcagatttacccagtatatcaataatgtcagaggagctggataaaatacgatataaagagcggtatttagagacattaaaaaatactattttcacgcttgttactgtcgttgcacttgcagtattaatagccatgttatggttgccagttctacatatttatggaagttccatgtctcctactctgaaagcaggtgatatggtagcaactgtgaagacaaatacactttcaactggagatatggttgcattctactacaataataaggttttggtaaaaagagtagtagcaacttctggtcagtgggtaaatatagatgagcaggggaatgtttatgcaaatggaaaaacattagacgaaccctatgttaaagataaggcctatggtcaaactgatattaaactaccgtaccaggttccagaaggtcaatattttgtaatgggagatcatcgcagtgtatctattgattctagaaatacagctattgggtcgattggtgaggagcaactggttggaaagttaacctttcggatatggccatttcataaaatgggagtaatcaaataaaggaaggagatataaaacatgaaaatattatgggaaagattgtttaaatttgttcagcaatactttcgagagaaaaagactgcaaaaataactatggtgttgtcaataattatggcttttggaatatcatatttgctgattttaccagccattactttagagacagacagtcaggagagtgttctgcaatcagtctataatcagccaacaacagtagaacagccagttcaagaagaacaggcggagtcacaattggcacaggttcaatctgctggaagcttattcgctgaacatgaaaatataactgtacaagttaactatgaggagcatacatttgaacagccagttcggttacaggttttaccctcagaagatagtacaaaatatattggacttgttcggtaactacatcatctcatggttgatgataccacaaatcaactcagttcttaattcaaaccgttttctacgattacgatagggctgtgccatgattttaaaggttttaaatttggcattaaagtgttcaacttcaatacggattttagctatctctcgattcaaccgtctatcctcttcggttaagaggtgatgtttagaatgcttagcaggaataaaggtattttcgtgaaatttcaagatgcctaaataccctaaatctacgaaagcaagggtattttggggcaaactatagccaatactctccttaaaaagggtaaaatcatgcgtatgaccatctgaaaaagccaattgacaagcacgatggctagtcaaatcaggcatgatttgagtctgctagtctttttcttaataactggcctattattgttattatatccaacagtaagtgattattggaactcacattatcaatcagaagcagtagctacttattctgagaaattattggatatttcaaaagaagaaaaacaaaaaattttagaaaatgtcagtgcatataacaacacgctcgaaaaggggacaatacttaatttaaatatagacagtgtagctttaaaaaagtatgactcaattttaaatatcacagatactggtattatgggctatgtagaaattcctaagttgcagacaacgttacctatttatcacggaacggatgatgccgtattgcaggtagcagtaggtcaccttgctgggacttcccttcccattggcggtcagggaagtcacgctgctatttcaggacatcggggattgccttctgcaaaactgttttctgatttagatcagctggttataggggacacatttatgatacaagttttagataacactctgacatacgaaattgataaaattattacggttactccagatgatgtatctcctttgatgatagatccgaatgaggatttcgtaacccttgtgacttgcacaccttatggtgttaatagccaccgattattagttagaggtcatcgaattgaaaatcaactacttgctaggcaagtagtctcagaaggatcaattgtaaaacctatactggtttctccttttattgctttatgtttattaggactactttggagtttattttttataaaaaaagaagtaaatttgtttatgtgacttagataatatcgcaaagaatgtcaaaccattcgactttgttctttagcttttaagcttaggaaagggaggtttttcaactcccaatcatccaaaaggtgaaatagaagataaaccaaatgacgatatgtcaatgtcctctatacgccagaaaaaggtggcaagcgagcggtcggctacggcattgaaattcccaaagaatttgaaggcaaattcaagtttgcccgccaacgctccaaactagctggggaaatccgtggcactttcttcgttgtcaagggtaactatttataggggagaaaatctggggaaactcagattttttgtcgcatacttgacttcaaggtatataatagatatacaaaacgaagggagaatgaatatgaacattaaagaagttagtgatgtaacaggtctatcggcagataccattcgctactatgagcgggtagggcttattcccaaaattgcaagaaaatcttctggagtaagggactttgtggaaaatgatgtagccgttttggactttgttcgctgttttaggagtgctggtatgtctattgagcgcttgattgagtatatgggcttggtgcaggctggcgatagtactgtggaagcccggattgatttactaaaagaggaacgggaagtcctgcagtcacgcttgtcgaaaattcagcaagctctagaacgtttagattataagatagaaaattaccagactatattaagaggtgcagaaaatcaattgtttacagacggcagtggttcatgcaaaaaagacagagaataactttctctgtcttcatacttcattattaattttttctgataacttgtttgggtttaaatttcttctttagtccaatttgaaccaaacgtagtccaagaaaacccgtcgcacttgccaatatgatggcaataaaaacaggaatgcctacagatagatagacataactagcgatgactgttatcaaactaaaaaatgcgatattaacaaaaaacaacaattcctttagacgttctttattggcattttttgcttgataggtttgaaaattagcctttttctctttcgggatatactcttcgtactggtactcatgggactgatagtgtcttaatggcatatcgtctccttttctgctctttaaagaataccatatcattgatgaattattatgtcatttatattacaataatgttacaagaaggatattagaaaagtctgaatattaaaacacggctagtcacttatcagatatttctctttttgatataattatccttatggaaaaaattatcattacagcaacagctgaaagtattgagcaggtcaaagaactgcttgtagcaggcgttgaccgcatttatgtaggtgaagctgaccatgctcttcgcatcccaacaaattttacctatgatgaactcagggaaatagcagagctagttcatagcgctgggaaggaattgacggtcgctgccaatgccctcatgcatcaagatatgatggacaatatcaaaccgtttatggagctaatgagggaaatcaaggttgattatctggttgtcggagatactggaattttctatatcaataaacgtgatggctacaatttcaagctaatctatgatacatctgtctttgtgacttccagtcgtcagattaacttttggaaagatcatggagcagtagaggctgttttggcaagagagattccatcagaagaactctttgatattgctaagaacttggaaatgccagcggaaatcttggtctacggcgcctctgttattcaccattctaaacgaaccttgttacagaattactacaattttacaaaagctgatgagacagatttgtcacgtggacgcggacttttcttagctgagccgagtgacccagatagccactattccatttttgaagataagcatggcacccatatctttatcaacaatgacattgatatgatgaccaagctgtcagaattagatgaacatggttatcataattggaaacttgatggtatctattgccctggtcagaactttgtggaaattgttaagctttttgttcaagcaagagatttgattgaaaaaggcgacttcacttatgatcaggccttccttttggatgaacaggtacgtaagctccatccagctgaacgtggcttggatacaggcttctacgaatttgaccgcaataaggttaaataataatatttatagcagaatttatttactttaacctgacagagttagctctgtcacttacaatgtaaggtcagagcacgaaaacgcctttgggcgattttctaatctctgccctaggtttccgagtgaaacaacatcgtttacagtattctatcctggcagagttagctctgtcacttacaatgtaaggtcagagcacgaaaacgcctttgagcgattttctaaactctgcactaggtttccacatggaaaagtatcgtttcatgtggaaaccgtcgcaaatagaggagattttacatgatgtcaaaaacattaaagcgtcccgaggtcttgtcacctgctgggactttggagaaattgaaggttgccattgattatggtgctgatgcggtctttgttggcggccaggcctacggtctgcgtagccgagctggtaactttaccatggacgagatgcgggaagggattgaatatgcccatgcccgtggtgccaaggtctatgtagctgccaacatggtcacccacgaaggtaatgaagaaggagcaggagcctggttccgcgaattgcgtgacatgggcttggatgccgttatcgtatctgacccggctctcatcgttatctgtgcaaccgaagcgccaggccttgaaatccacctgtcaacccaggcttcttccaccaactacgaaacctttgagttttggaaggaattgggcttgactcgtgtcgtcctggcccgcgaagtgactatggaagaggtggctgaaatccgtaaacggacagacgttgaaatcgaagcctttgtccacggtgccatgtgtatctcctactcaggtcgttgcgttctctccaaccacatgagcaaacgcgatgccaaccgcggcggttgctcccaatcttgccgttggaagtacaacctctacgacctacctttcggcgaagaacgccgttcgattaagggggaaataccagaggagttctctatgtctgcagtggacatgtgtatgatcgaccatattccagatatgattgaaaacggggtcgatagcctgaaaatcgaaggccgtatgaaatctgttcactacgtatcaacagtgaccaactgctacaaggctgcggtagatgcctatcttgaaagcccagaaaggtttgaagcgatcaagcaagacctgattgatgagatgtggaaggttgcccaacgtgaattggcaacaggattctactatagcccgccgagtgaaaatgagcaactctttggagcccgccgcaaaattccagaatacaaattcatcgccgaagtagtggcttttgacaaggaaaccatgactgcaaccattcgtcagcgtaatgttatcaatgaaggtgaccaagtagaattttacggaccaggtttccgtcattttgaaacgactattcaggacttgcatgattcaaatggagaaaagattgaccgcgccaacaagccgatggaactcttaactattaagctggaccgtgaaatctatcctggtgacatgattcgtgcctgcaaatcaggcctcatcaacctctaccaagaagatgggcaatctctaactattcgtgcataaacatatagacatttagtttttcttttattacttcgacgtaagaggaaactccgtttccttatttccaacttcaaacactccactggattgtttgaactcgctttgccgtactctgcaggggtgacttgctccgcaagtgctatctccaacctccaaaggttccccaaacctttggagcgagtactaaaagtaaactaaaagactataaaaaggctgaaatttcagcctcagaacgtagataaactcttaaaaatataaaaaaatgaagaagtttgcgaaagatagcaagtcattaaactcttagaaacattgatatttcggcgtttctgagagtttttaattttcaacataaagaaaaaagattgaagaaaattgtccaaaatggactttttcttcaatctgcaaggctgaaatttcagccttttgtttgttgttgagaagtcttgatgctatctggaaccaaggtgacttttttgatgtcctcgatttttataatgctggtaacctgacgtttgaaatttttcatgataatccgttggcgatcggtatcatatttcacaatgtcacctgtgaaactacgatcaccatagatgacatggactgcagcttttttatataaagccagctccaagttattcttgatttcttccttgctatctggctcaatagacttaggagctttgccatgttctaaaaagatggtgaactgctcgaaaataacttctaaaaacctcttcatggcataatcctttcaaacttgatataattatattatctaatttttataaaaatgacaagctttttcgaatagataagtgaggaggtaacaaatggcagaatttacatttgaaattgaagaaaaattattggtcttatctgaaaatgataaaggatggaccaaggagcttaatcgagtatcttttaatggcgcaccagccaagtatgacatccgtacctggagtcctgaccataccaagatggggaaagggatcactcttagtaatgaggaatttcaagttctactcgacgcgtttgctaataaataaatgaaggaagcctaagcaaaataggcttcttttttgataacaggttgcaataaacgatgacaaatcatgactagtgtaattttagctaaatcaggaagaatgaaaggcagaacagtccagccgatagtgtcagtccaactggcacctgaaactagtttaaatacacaacagccgagaaggaaacagatacttgttccaagtaggcaggctagaaaaattgtaactggtgaggagtctgatttagtgagggcagaagtgatgatagtgtagagtagaaacccccatagaaagccagatgtcggtcctgtgagtgcagcaaagccaccagaaaaaccagcaaaaacaggtaaaccgatagcgccaagaactagatataagctgacacttgtaattgcctccttgggtttgtatagacaagctactaagccgatagctaaggtttgtaatgtaaatggtacaggtccgatagacagactgatttgtgaaagggtggaaattaaggctgttccaatagcgatataaacaagtgatttgatagaagttgttttcatttgttatcctcttaaaattttatggttaacaaaaattatagtgagattggataagaaagtcaatgctctttcatcggctgtaacaactctataggtgatttttataacagctaataagaaacttatatagttaaaagcaataaattatatgtaaaacaacctatacctatgctagaataataaaaaaagaaagtgagaatttctatgacagaattacttgatatttaccgtactcttaaatctaaaacttgggtagacttgactcaccaaatcaatgaaaagagcccgcatttccctgcgctaccagctctcgaaaagaaagccctatttactcataaggatggcttctttgtcgaacaatttacggttgtggggcagtacggaacccatattgatcctccgattcattttgtagaaggggctcgttatcttgatgagattgatttgaaagatttactcctgccactctacgttattgataaatcagctgctgttatagaaaataatgactatgagataactaagcaggatattttagactttgaggctgaatatggtccgatagcgccaaaatcttttgttgcctttcgttcggatttgtcaaagcgctggcctagtcaagatgccattcgtaatctagacgaagatggagttcaacgtacaccaggatggagtcatgaagctctagaatatttgattgaagaacgtcaggtgaaagcagttggtcatgaaacattggataccgattcaggagtatctgcagccaaacacggaggaagtttatcagaagaatactatctcctatcaaaagatatttatcagttggaagtattggcaaacttggatcaggtaccgccaacaggtgcattgatttcaatcgcttttcctcattgggagaaggcttcgggttcaccagtgcgagcaattgccatattaccataaaaaaagtccagacagtgctgaccttcatgtctggactttttcaattgagttaacgcatagtaacaaattcttcagaacctgtcggatggatggcgacaacggcatcaaattcttcttttgtagctcccattttgatagcaactgagaatccttgaatcatttcatcgacaccatagccaatgccgtgcagtccaacgactttttcattttctcccacagttactaatttaaacttagccatttggcgattgttttctagggcagtgtacatagaagtaaaggctgaagtatagacttttacattgtcctgaccgtattgggtaatcgcttcgtcctcagttagaccaacggttccgatagcggggtgagaaaagacgacagttgggatggttgtgtaatccatttttgcggttggtttattgttaaataaacgttctgccaaaaggcgacctgccttgattgcaacgggtgttaattctttttcaccagttacatcaccgagggcatagatgcctggtacagctgtttcttggtattcattgacagaaatatgtcctgaagaagtaagttgaacactagttgctttcaggttgagtttgtcaatatttggtttacgtccaattgcccaaaggaccttctgagcaatatggttactaccgtcagcaaagttaatctggatttgtccatcatcagttttttcaagactgacaggagttttcccggtatggagtggaaggttggtacgttgcatttcttccatcaaggcatcaacaatgtaggtatcaaagctacgaagagggcgattaccacgaacaaataggtcagtttggacaccgagtccatgtaggagaccggccatttccacagcgatataaccagcaccaatcacagccacagaagagggtaattcttcccatgcaaagacatcgtcagatacaatccctagctcactaccaggaatagcagggactaccggtttggcgccagttgcgatgacaatgtgttttgcacgaatcagttcaccattgacttcaaccgtttgattatccacaaaacgtgcgaaaccctggataacttctacttcgttattgttaaaagtattaccgtaggatgcgcgtgaacgctcaatataggcttcgcgatttttacgcaaggtggcaaaatcaaaggtcacttcttggctagtaaatccatattcaggtccataatgctgaatggcttctgctacctgagagccgtaccacataatttttttgggtacacagccaaggttaacacaagtccctcctagatagcttccctcaataactgctgccttggcaccgtacatagcagctcggttcatggtagcgatgcctccgctcccaccaccgatagcgataatatcaaacactttcataaatttcctccaataaaggtcaataattatattcattgtaacgcttttttgtatgtcaatcaaaaatctgctacgtcaccttacaaaaatgtaagtgggaaaattgccgaactttttataaaatagttaggaaaaaacttgcatttgttcttgtatttgtgtattatatagacaacacaaataggtatgttttgtaaagaaaaggagtttgttatgttaaaaacaaagaaagcaaaaattgctttgtttggtggtcttggagtggtcgcagttgccttagtaggtggggctttgatttttagcaatatgctaacatcaccatcatcttcagaagatgtagccatgagtatgacctatactgttgctaaagaaggctcaattgcttcctcaacgctacttacaggaacgattacagcagcagacgagcagtatgtttactatgatccttctaagggagatttgagtgaggttttggttgctccaggtgctaaggtcgaagtaggtacccctttgattcgctatgatgctacagaattacagtctgctttggatactgctgttcgtggtcgtgataagattggtcgccaaattgcagacttaagaaccaacggtcagactgttcaaacaactggtgatgcagaaacagatgctgcagcaactgctactgcacaacgttcagtagatatgcagttggcagacttgaatgattcatacgcagatgctcaagctgcggttgataaagcatatacagccttaacagaagcgacagtaactagtaccgttgctggtacagttgttgaggtgaataaggctgtttctaagaattctacatcgagccaaacagttgtacacattgtaaatcaaggtagtttgcaagtaacaggtagtttgacagaatacgatttggctaacattgcagtggatcaagaggtcaagctgactagcaaggtatatcccgataagacttggacggggaaaattacctatatttcaaactatccatctagtaatcaagctggtgctgctacaacaggaaccagtggttcaggtgccaaatatccatttaaggcagctttaactagtgaattaggtgagttgaaacaaggattttctgtaaatattgaggttgtcaatacaagtaaaaacattttaattccggtgtccgcagttgtgccagaagaagataaaaactatgtgtggaccttggttgatgggaaagctaagaaagtagaagttactctggggaacgcagatgctttgaaccaggaagtgaccgctggtatagcagcaggagataaggttattaccattccaactccgaatctcgaagatggcaaagaggttgaagccaatgaagaaccagcttattagactaacaagtatcaataaatcctacaaaaatggtgatcaagaactccgagttttaaagaatattgatttagaggtggaagagggagaatttcttgccattatggggccctctggttcagggaaatcaaccttgatgaacattattgggcttttggatcgtttcagttcaggaaactattggctggaaggtgaagaagtcagtcaactttctgagaaaaaattagctcaggttcggaatgaccaaatcggtttcgtctttcaacaatttttcctcttatcgaaacttaacgcccttcaaaatgtagaattacccttgatttatgctggagttccatcaagcaaacgtaaggaactagcaaaacagtatcttgaaaaagttgagttggcagagcggatgacgcatttaccatcagaattgtctggtggtcaaaaacaacgggtagctattgctcgtgcactagtcaataccccagctattattttagcggatgaacctacaggggctctagataccaagacaggtgagcagattatgcaacttctgacggagttgaataatgaaggaaagaccattatcatggttacgcatgagcctgagattgctgcctacgcaaaacgaaaaatcgttctacgtgatggagtgatcactgaagatagtcgaagggagggagtttagatggaaaattggaaattcgccctcaaatctattatggctcataaaatgagatcgctccttactatgttaggtatcatcattggtgtggctgcagttgtcattattgtcgccatgggaacaggggtggccaaaagcatagaaaagtctctagctggtgatcaaaataatgttcaggtttactttactgctttctccagttcaggtacagctttcggtccgtttggcacagcgtcgacagaagaaccaattttagaggaagagccggatttgacggattctactttaaaaggactgctagagattgatggcgtatcaaactattactccagcatcagcaacatagctgaagtcagatcgggcaataaaaaagcagagaatgtcactattactggtgttagccagaatttctttgctgtgaaagagtatgagattttagctggtcgtcagtttacagctaacgactatagtcgtttttcacgtatgattatgttagatacggcattagcagagaagttatttggttctatagagaactctctcaatcagacgattagtgttaatagcaatgcctatctagtaataggggtctacaaagatccgaaagcaggcacagctatttatggaatgaattcaggtggaaatgccgtcatgactaatacgcagctagctgctgaaacaggcatgaaagaaaattctcaaatctttgtccatgttgaagatgttactcgggcaacagaagttgggaaggctgctgcagattacctgactaaagcgactggattgaaagaagcgagatacgagatttatgatatgtcagctatgttggaggagtttaaatctcaaatgtctggcgttacattgtttatcggtgctgttgcaggtatctccttgctagttggtggtatcggtgtcatgaatatcatgctggtatcagtaactgagcggactcgtgaaatcggtcttcgaaaagcgcttggagcaactagaggaaatatcttgattcaattcttgatagaagccatggtcttgaccactcttggtggagcaattggtctcgcaatcgctcagacaatagttttcttgctcaatgtgagcaaggcgttgggcgaaagaatagctgctgaaatttcaattcctgttgtgttaggtagtctggctttctcagcagtagttggtattgtatttggcgtactacctgccaacaaagcatctaagcttgatccaattgaagctttgcgctatgaataatctattgaaacgattaggttttcctagtcgttttattttttgagcaaattaattgaatttatcactaattagcgataaaataaacgcatcaattaagaaatagtgatttcaaaggagaacacatcatggtagaattaggtatttcaacatttggcgaaacaactccactagaaaaaacaggggaaacttacagccacgacgagcggattcgccagctagtcaaagaaatcgaactagctgatgcggtgggacttgatgtttatgggattggggagcatcaccgagaagatgttgcggtttctgcacctgagattgtgctggcagctggtgccgtcaataccaagcatatcaagctaacatcagcagtttcaatcctttcctccatggatcctgtaaggctctatcagcagtacaccaccattgatgctttgtcaaatggcagagcggaaatcatggcgggtcgtggttcctttacggagtcattccccttgtttggctatgatctccacgactatgaagaactcttcgatgaaaagctagatatgcttctggaaatcggcaaggaaaccaatctcaagtgggatgggcattttacccagtcagtcgataataagccagtctatccacgtcctgttcaggaagattttccgatctgggttgcaactgggggggattgtgtcataataatgacaggtgcttaaaacgctgtcaaatcaaggatttgagtgttctacaatctgtcattaaggaggaaaaatttattttttatttataatatcatatcgcacaagcgaggacattttaataagtgttctcgtttttttattttaaggaggaattcatgaaaaagaaggaacaatcatcacgccaaatcgtgatgtgtcatctcgtggctattttaggagttgatattgagaaagcaacacagctaattgatgaaatggaacaagtaggtttaatccgatttgatgaatttggaaatgttggaatattagtcttggagggacaatcatgaaacgaattaccgctaatcagtatcagacatcagagcgttattatgaactcccaaaagtcttgtttgagagtgaacggtataaggatatgaagctggaggttaaggtagcctacgcggttttaaaggatcggttggagttgtctttgagtaaaggttggattgatgaggatggggctatttatttgatttattccaattcaaatctgatggcacttttaggctgttcaaagtcaaaactactctctatcaagaaaatattacgcgaatatggcttaatcgatgaagtccaacagtcctctagtgaaagaggtcgaatggcaaataaaatttacttgggggaattagaacatgaacctaccccagtcttacatacagacggggctagtgttaaaaaaacactaggggggtctcaaagaaagacggggccggtcttatattcagcccctagtgagactgaaggaagtgaaactgaatatagtgaaactgaagggagtgatttccttattgaggacgaggaggagaggcagctagtagatgagaaacaagaagagaactttacttcaaaagttgatggcgtgaccaagtatgatcgagactatatttggggtttggttcatgaccagttaagacagacaggtttatctcagtcggctagtgactatgccatgctctattttagtgaccgttatcagtatgctttggaacatatgcgatttgctcggtcagcggaagtaatagctgaatacgtatttaatggtgtgctgtcagagtggaccaagcaactgagacgacaagaagtaaagggaggtgattaagttgatttggtggatactaggtggaatctatctgatttctatcgtcattttgatttttgaaatcatccgtgcaccagaaatggatgatcatatataagcaagagttttacaagtgtaaggctcttttttagttggaaagagaggaaaaatgaaatttttagatttatttgctgggataggcggttttaggctagggatggaatcacagggtcataaatgcctgggcttttgtgaaattgataaattcgctagaacatcttataaagccatgtttaacacagaaggggaaatagaataccatgacattaaagaggtcacagaccatgactttagacaatttagagggcaagtggacatcatctgcgggggatttccttgccaagctttttcactcgcaggcagacgattgggatttgaagatactcgagggactctcttttttgagattgctcgagcggccaaacaaatccaaccacgttttctatttttggaaaacgtcaaaggcctactcaatcacgacgagggacggacgttcgccacaatcctctccacgatggatgaattggggtatgatgtcgaatggcaggtgcttaacagtaaggacttccaagtcccgcaaaacagagagcgggtctttattatcggacattctagaagataccgttccagattcatatttcctctcagaggagaaaacagcccagctcatcttgaaaggctaggaaatatcaatccctctaaacgtggtttgaatggtgaagtttatctgacgagtggacttgctcctacactaacaagaggtaaaggagagggggcaaaaatcgccattccagttttaacaccagatagactagaaaaacgccaacatggtcgtcgatttaaggacaatcaagaccctatgtttactttgaccagtcaagacagacacggagttgttgtcgcaggaaatctgccgactagctttgaccaaactggaagagtatttgacatttctggcttgtcaccgactttgaccaccatgcaaggtggagataaggtgccaaaaattttgctgagggaggagctgccatttctgaaaatcaaggaagccacaaaaacagggtacgcaaaggcaactcttggagactctgtcaatctggcttatccagactcaaccaaacgtaggggacgagtgggaaagggaatatccaatacgctgacgacttcagacaatatgggagtggtagttgctgctatggaatatcgacaggctaagtggtatgaagtcacaggcattgtcttagaggggaaactttatcgcctgagaataagacgactgacaccaagagagtgtttcagacttcaaggctttcctgattgggcttatgaaagagcagagagtgtttctagtaagagccaactatacaaacaggccggcaatagcgtgactgtcacagttattgaagccattgccagagaatttagaagaacggaagaggaagaaaaacatgaacctactacataagaaaagtatcctagattgtactgaattagaagaacatattcaccaagttgaaactaatcagttattacaaaagatactgtcactccccaattttgattgtgactttgaggtgacttttgaagatgattaccacaaagagatgaatgatcccctattctacgaatccaatcttcatcggatttcggattttatggaaactagggatattaaaaatggtgtagatacactattgacgaaagacaatcacctggcctttcgtgcctttggtgaaaattattctgctaggggaaaggatggcattttaacgactctagtgacggtcaagtgttttggtgaaggacggatgcccattgatatgagtcgctatttctcaactccagaaccaacagttgaaaatagcctaaccctataaggaggagcctatgcttgaggtatatctaggaaataatgccaatacaaatcaagacttactagccattttgacgacctatggtgtgacttatcgttgtataaaagcgtgtgatgtaaaccgtgaaatcttactgtcactctttgccaaaaccacggattgttttgagttgctgtcgccacgatttcttcgctttaagcgtcaatattcgataagtttgaatgagatgattcagctcattctccaaaagccagaccaaaaccttcgtctgcctctcattgtttgtcagaatcatgtctatccagctattgggctagacgaagtgcgtacctttcttcccagacaagtaaaagaagagctgtttcagaccagtctgatgaaacaagtgacagggtaggtgtgaagatgaatgaacgattttgggacaatttagaaatcattctggcagaaaaagacctcacttgggcagaactagctcgcaaagtattcaaaggtcaatatgtttatcccagtgagtttaatcgcctctatcaaaaattacggcattacaaatccaatcggctgatgccccagacaagatgggttgagcgtattgttctagtcttagaaattgattatgaagatttatttaagaggtgacaatgataaggatagtggtgttttatctagctatacagcttaacggtcttctggtgagtttatacctgaaagagtatctgacaatagagggtatagtcttgctacaattggtcctattaagtgtgacttgcttagagattgcccgtcataaaactgttcaagcaaaaaatataaccttgagaaatcgcctaagatggtttcttcttggctttgtggctatggttgcttttgcagtcttcatcagcttcctatttccaggtcagactaggaatcaagcggtattggtacaagtaggaaaacaggttcctcctattatctttttattgtttctggtcaatgcaagtatccttgaagagattgtttataggcaattgctgtgggaaaaattgacattcccttttgtacaaataggcgtgaccagttttctctttgttctatcccatggccccaatcagttagggagttggctcatgtatagctgtcttggcttgaccttggctgctgttcgattgaaaactgattgtatgacggcaatcatcttacatttactttggaatagtttggcttatgtcgtaactttcttgtgataccaaaatcaagagtgtttccgtattatggaaacaccttatgtttgagagggaatcgaaaaaaagaggaggtcaccatgtcatctgaacaacaagaacgtcaagcgatgcaatacgtggaaagaagtagtttattgacagtcagaaccctcttaaagctcttagaatggtcggctaggcaagccttagctcaagattcagcttataagattggggttcaaaaactggaagaactccttcaaagcccttacgcaattgaagcgatagatgttagtaaagacatactggataagccaatcgatgtggagaaatttaaggagttgatggagtcagaaaaactgccaatcgcaattagttggcaaaaagactatctctacttttatgccaaggataagaccttgctcgatcatcacttggatgaattgttgaagaaactgatgtctaatccagagaagctagaaggtttaacctttgataaaaccttggaccaagagatagaactggccaaagagaaaattagagtgacagaaccttcggcagtcaaaaccaaggaggtgaccttgtaatgtattccaggcaaaaagcatttgtctttggactcttgggtctcgcctttggctatttctgccatcgtctaaccctactctatgatagtttaaccaatgccccacctatggaacgtattgcctacctcttaggagaggggttaaatcaggttttcaatcctttatggctattttcctttactcaaaaatcttttcttgcctttatccttggggttctaacgatgacgctagtctatctttatgtatcgacaggacagaaggtctatcgagaaggggaagaatacggttctgcacgatttggaaccagtaaggaaaagcggaacttttacagtaagaatccttttaatgacacgattttggctcgtgatgttcgtctgaccttgttggaaaagaagaaaccccagtttgatcgaaataaaaatttgattgtcattgggggttctggggcaggtaagacctttcgctttgtgaaaccaaaccttatccaacttaactgttccaatattgtcgtagatcctaaagaccatttggctgagaagacaggtaaactctttttagaaaacggttatcaggtcaaggttttagacttggttaatatgaccaattcggacggttttaatccctttcgttatgtagaaacagagaatgatttgaaccgcatgttaacggtctattttaataataccaaaggaaatggttctcgcagtgatccattttgggacgaggcttccatgacattggtgagagctattgcctcttatttggtagatttttacaatcctccaggaagttccaagcaagagcaggaagcaagacgtaagcgtggccgttatccagccttttctgagattgggaaactcatcaaactcttatcaaagggagataatcaggacaaaagtgttcttgaagtcctgtttgaagattacgctaaaaaatacggtcatgagaactttaccatgagaaactgggcggattttcagaactacaaggacaagaccttggattcggtgattgcggtcacaacagctaaatttgccctctttaatatccaatcggtgattgatttgacgcaaagagacactatggatttgaaaacgtggggcactcaaaagaccatggtctatcttgttattccagataatgacactacctttcgtttcctatctgctttatttttctctacagttttctccaccttgaccagacaggctgatgttgactttaaagggcaactgccgattcatgttagaagctatctggatgagtttgcgaatgtcggagaaatcccagactttgctgaacaaacctcaacagttcgctctaggaacatgagtctagttccaatcttgcaaaatattgctcaactccaaggactttataaggaaaaagaggcttggaaaactatactggggaattgtgacagcctcctatatttgggtggaaatgacgaggaaactttcaaatttatgagtggtctattaggcaaacaaaccattgatgtcagaagtaccagtcgttcttttgggcagactggctcaagttctacctctcaccagaaaattgcccgtgacttgatgacggctgatgaagtagggaatatgaaacgagatgaatgcctcgtacgcattgcaggagttcctgtttttcgaaccaagaaatattttccactcaaacataagaattggaaatggcttgcggataaggaatctgatgaacgctggtggcactatcatatcaatcccctaaccgctgaggaagaggtagatttgtcaggccataaaataagggatttaagcacagaaaagacactacattaatagaaatgaggaattatatgaatcaaaaactaacaggctttgtttacggagtggacgccagctccatgttctctcaagccatgtctctattacaaaaaggcttaattgcagtaggagcctttcttgttgtcatgggcattatcaacctttcaaccaacattaaagatggtgggccaggtgtccgaaatgccattctagaaattgttggtggagtcatggtgggagccgcgggtgcttttgtgactcagattaccatttaggggaggacagcacatgacatgataatgaattttacgtcaccttttgtatttctagcctctgaaaaagtatctagtgatagcctatttgaagggtttcaagtggatttagaatcaaccgccaacttggttaagtcactagcggactttaatccgacggtgtggtcttacatgacagccattaccaaggggattatgcagcccttgggagtagctattcttgcggttgttctcgtactcgaattttcaaaaatggccaagaaaatcgcaaactcaggtggtgcaatgaccttcgaagccatggcacctatgattgtcagctacatcatggtcgcggtcgtgattaccaatacgacggttattgtggaagccattattgcccttgcctcatatgttattgaacaagtggcaagtcttgtcacgaatggtggtgctaattacgataccatctcaggcattaagggatctggaattgtaggaaaaatgattattggcttttttgcgattctcatttggttggtacgaatggccagcatcatggttgtcaatatcttgattaccattcgctttattcaactctatctgatgattccttttgcccctgttaccattccgaccttccttagtgatgactggagaagtgttgggattggttaccttaaaaacatcatggtctatgccgttcaaggtattttgatttttctaattgtatctcttgttcccttgtttgaatcggctggaaagattgccgtatcaaatggagctggagttatggaatcactcgccattatgtttggtggcttggtacaggccatattgttaatcattgccttggttggcagtcaacggaccgcccgaagtattttggggatgtaggaggatgggagtaaattgcccgcctcctctttttatagcttatttagattggagaacatttatgaacacacgtgtctttaaggacatttcaaaggttcaacacagggcatggctgggatttacaactagacaggttatttttgtatttccagccatcgtcctaaccattttggtattgggcttgaacctattttactggcaatttggggattggtttgtctatggttttgtttttatctttaccattccactcatgttatttggggtctatcgccccaatgacttaccatttgaaacctatctcaggtaccgatttcattatgaactaacggtgccagaccgcacatttactggaagaaaaggagaccaacgtgaaaaaattaaaacactcaatgaaatcaaagacctcttctaatgacaaaaagcaaaagacgaaaacacagaagcaggagatcagaccatcaaccgtaaatacgttagcctatcaagggctttttcagaatggccttatgcaggtcagtccaagctatttttcacaaacctatctcttaggagatgtcaattatcaaacagttggcttagacgataaaggagctattgttgagaaatattccgatttaatcaattcactggatgatcagaccaatttccaactgactattttcaatcaaaaggtcaatctggaaaaattccgtaagagtattctctatcccttacaggaagatgggtttgatgcttatcgtgatgaattgaatcgcatgatggatgccaacttagaggcgggtgagaacaatttttcagctgtcaagtttctttcatttggcaagagcgaccaaacaccaaaactagcttttcgttctctgtctcaaattggagaatatttcaagagtggcttttcagagattgatgtatctcttggtttgctcggtggagaggagcgagtgaatgtccttgcggatatgttgcgtggtgaaaatcattcatcgttctcttacaaggatttgactctctcaggtcaatccaccaaacactttattgccccaacctacctttcctttaaacacaagaatcatattgaattggacgaacgattattacagattgtttatgttcgtgactatggcatggagttaggggataaatttattcgagacctcatgcagtcagatttggaagtgatgattagcctacatgccaaaggctctaccaagtctgaaaccatgaccaagctaagaaccaagaagaccttgatggaatcacaaaagattggtgaacaacaaaaaatggctcggactggaatctatttggagaaggtcggccatgttcttgagaacaacatcgatgaagctgaggctcttcttcaaaccatgacccaaacaggagataaactgtttgacaccgtatttctaattggcgtgcttgcggatactgaagaccaactcaaacaatctcttgatattatcaagcaagtggcagggtctaatgatatgattatcgataacttgacctatatgcaagaagctgcttttaatagtctcttgccatttgggaagaactatcttgaaggggtttctcggtcgctcttaacctcgaatattgctgtgaatgccccttggacttccgttgatattcaggacaagggtgggaaattttatggcatcaatcaaatctcaagtaatatcatcagtattgaccgtggcaagttaaatactccgtcaggtttgattttagggacttctggagcgggcaaagggatggcgacaaaacatgaaatcatctctacaaagctcaaggaagcagatagtgatactgaaattattattgttgacccagaaaacgagtacagtattatcggtcaagcctttggtggggagagtattgatattgccccagattctaccaccttcttaaatgtcttagatctatctgatgagaatatggatgaggatccggttaaggtcaaatccgaatttctcttgtcttggattggaaagctcttggaccgtaaaatggatggtcgtgaaaagtccttgattgaccgtgtgacacgactcacctataagcattttgacacaccgtccttggtcgaatgggtctttgtcttagctcaacaacctgaacaggaagctaaggacttggcactggatatggaactctatgtggaagggtcgctggacatattttcacatcggaccaatattaaaacagacagtcatttcctgatttacaatgtcaaaaagttaggcgatgaattaaaacagattgccctcatggttatctttgaccaaatttggaatcgggtggtcaaaaaccaaaagctagggaagaagacctggatttattttgatgaaatgcagctactcttattggacaaatatgcctctgatttcttctttaaactttggagtcgtgtccgtaagtatggggcgataccgacaggtattactcagaatgtagaaacgcttcttttggatgccaatggcagacgcattattgctaatagcgagttcatgattcttttaaaacaggctaagagcgatcgcgaagaattggtgcatatgcttggactttccaaggaactggagaaatacttggtcaatcctgaaaaaggggctgggctaatcaaggccggttcaaccgttgtcccattcaagaataagattccacaacacaccaagctctttgacatcatgagtacggaccctgaaaaaatgaggacatgagatgaaagaggataaaaagctagtcaaacaggctaggcaaaactttcgaagcaacttaaaatcagcccgtatgcattatcggaaagaagttagttccttaaagcagactgttcctaaaaaaggaagatttcgaaaatcagccaaaaattctctgtttcaggaaaagaaaacagagttaaaaggaaatctactcagtagtcaaaaggaagcagaagagaagttcctaaaggaaattacctatgtgtctcctagactgttaaggggaaaggaaatcaagaactaccgactttctcaagctcaagagcgtttgaggacggcaagaaaacatttgtcagaagtgaaactaagggaaaagtcaaaatcggtgaatcccaagtttactttccaaaaagaaaattcttccctgaagtctcgctttcagtttcaccaagaaaaatcatttgatcgactcagtgcagaaaaagacgtaagttctgccaagcgtgaggtcaaacaactcaagaaagtccgaaagtctaagaaaagttctaccaaagtcaaagctggattagccttagctgcatctgaatcccttgacctgatagcacaggaggatgatttagatggtctaagaaccatgaaggatactagtttgaaagccagacgctatggaaggtttacctttcaagcaggtaaggtggcagtaaaaagtggacagactggtgtgcggtttaccaaaacaaaattttctcatggaaaggaacgattccagaacttcaaaaagggaaaaggattcacacgccagaaacctcttaaaccaagaagacgctaccaaacctttttaaagcttgccagaaaacaaagtgtcgcaggtttcaaaggaatcgtccaagccattaagggaagtatgactttcttttctgtccttgcgggaaatcctttgacttggattgtctcaggcattctcttgatactccttttgatgatgagctttttcatgagtgtttcaggtagtagtgtcattcaacaagatgaaatagaattgagtaagagttatacccacatgacgttggaagatgcggaacatacaagaaacaacgaaaagggaattaccttttacactaagattgatgaggtcatggtttacatgaatcatcaataccaagactacaagcttgacgatttcatggaagcaggtggtgtgacctacaaagcgtttctcagtcaagtgtggacagacttaaatggtggagattctattaaatccatgtctgacttatataaagaacctacttacaagttgtctgatgaggaccaggaagagttaaaggagttgacagaaggaggcaactatctagcccttcaagaattggacaatccctttcagggacagactgacgaggatagcttaagcatgacctaccgatatgggtatgaggtcattgatgagaaaccaacgcttcatcatcatatcatcttagaagcgaaagaaggtcaagtcattgtagctccgatggatggcaaggtatctcttgatggagagaacgttgttttgacatctggtaagggagtgaataagactaaactaaccttgtttggcattcattcaggccgagtgagtgaaaatcaacaagtcttggcaggagatattattggtcagactaaagacggaacgggtctaaaagtcacctatcaaaaggttgatgatgacacggataagctagtctatgtcaatccagctttctactttccaaaagtgattcaggttcagaccaccattcttccaactatcggtcagtttggcggcgatgagtttgagagagccaaggcaatttatgactatcttaaaagcaaaggtgcgaccaatcaagctatcgcagccattctaggaaattggtcggtagaatcctctattaatcccaagcgtgcggagggcgactatctatctccccctattggtgcgacagacggttcgtgggatgatgagggctggctctcacttaatggtccaactatatataatgggcgttacccaaatattctcaaacgtggtttaggcttaggccaatggacagataccgcggatgggtcacgcagacatactttattgttggaatatgccaaaggaaaacatcaaaagtggtatgacttaggcttacaactggatttcatgttgcatggggatagtccttattacaccaactggttaaaggacttcttcaaaaattcaggtagtccagctagtcttgcccaactctttctcatttactgggaaggaaatagtggtgataaactacttgaacgccagacaagagcaagtgagtggtattaccaaattgaaaaaggctttagtcaacctaacggtgggacagcacaaagtgatccaaaagcacttgaagctgtacgaggagacctttttgaaaactctgttccaggaggtggtgacggtatggggtatgcctacggccaatgtacttggggagttgcagcccgtatcaaccaactggggctaaaactcaaaggtaaaaatggtgagaagattccaattatcagtaccatgggcaatggccaagattgggttcgtacagccgcaagtctcggtggagagacagggacaagtccacaagctggagctattctttcctttgcgggaggaggacatggtacaccaacagaatacggacatgtggctttcgtcgaaaaagtttacccagatggctctttccttatctccgaaaccaattacaatggcaatcccaactacaccttccgtaaattatctggagtggatagtagcttaagttttgcttatacgacgaaataatattagaatacttgtcttcttgtcctaaatgttgtatgatatttgggacaaagtggtcatctcatctaaactttaagcgtgaacataggtgttgacaaataaggaattatcccgtataataagggtaaataaagattataaattacttgtgggctagtggatatggtctgcacccgcctgtgggctccgcactcagttcaaactgtttgttgagaaaaagaatagcaggactgcctacccttgaggaatagatagggcatatctagcgtgaggtgaaactcaatacgtggaagagaaggaagcacctgcttccttctcttttttgggagaaaaataaaatgacatatactttggaatggctcgagacctttgatggagagattgatattctcaatgtcgatatgtcttgtttggccaatactattgagaaatatgtttctcagtacaaatacgtttatcagacaaatatggagaactatcctgaaattgttctctccgtcccaaattcctctattccccatctattaggattatcaagagatcatcatgtcaatttaccaactaataatgcagggagtatttttgaaggattaaaggatgattggacattgcagcgtctaaataaggctgataatggatggtttaacgaaaataaattcaaaatcgttggcacattactactttatcaaatgttacatgtgatggaatgtaaattttatacaacggatggtattttgaatagaaaagttggtaaacgatttagaagagataatatttattttgtggtcttcaaattaagtaatggtattagttataccgttgaattatcacatgaacaaggaaatcaatactttccaagaagtcttaaaatcaacgacaccttaattacaaattgtagagaaatagagctgaaacttgttgacaagaaacgctttaagactgctaaagttagaaaggttaattggccgtcttaatgtaaaaattgatatgctgataatcaggtcatccactttttgtgggtggctttttcttttccctgaactaattgtgataacaaaatcaagccttcttttttatgatgaggaaagagtaacgagtttgttgctacataaaaaagaaaagaaggactatttatgaccaaaacatgtaatcatcactttcttgtcaatcaggaaaaaggcgagaaacacgtctttcgcaagagtaaaaaatatcgcactctatgttccgttgcccttggaaccatggtgacagctgttgttgcttggggaggaacggttgcacatgctgatgaagtcacatcatcagttgacaccgccattcaacgaacggagaatccagccacgaatttaccagaagcacaaccaacccctgtttctgaacaaactgaaagtttagggtcaactggacaatctaacggtgcaattgcagtcaccgtaccacatgatacggtagcacaagcagtggaacaggcaaaggttgaaggtgtttctacggttgaagatagcccaatggatttaggaaatacaacttctgcggcagaaaccaaccaacaaatttcaaaagcagaagaagatgcccaaaaccaagttgaggctatcaatgaagtcactaaaacctacaaagctgacaaagcagcttatgtggatgaaaaagttcgcattgaacaggaaaataaggtgctgtcacaggcctacgagggggccaaccaaactggtaaagagacaaacgcttgggttgattctaaagtcaatgacctaaaaactcggtatgcagatgctgatgtgacagtaaaagaacaagtaatttcatcaggaaatgggacatctgtactagactatacaaactatggcaaggctgttgaaaccattcaatcaactaacgaacaagctgtagcggattatctaacaaagaaaacaaaggcagatgatattgttgcgaaaaatcaggccattcaaaaagaaaatgaagcaggacttgctaaggcaaaggcagataacgaagccattgaaaagcggaatcaggcaggtcaagcagctgttgatgctgaaaaccgtgcaggtcaagctgcggtggatcaggctaatcaagagaagcaacaattcgtttcagatcgtgcagctgagattgaagccattactaaacgaaatcaagaaaaagaagccacagccagaaaagagaatgaagcaattgatgccgataatgccaaagaattggaacgctatcaacgtgatttggccgagatttcgaaaggtgaagaaggttatatttctgaagcccttgctcaagccctcaatctcaataacggtgaaccccaagcacaacatggggccattacccgaaatcctgatcagatcatttcaactggcgatgctttgctgggtggctactcaagaatattggattcaacaggattctttgtttatgatagcttcaaaacaggtgagacccttagttttaactatcaaaatcttcaaaatgcacgatttgatgggaaaaagattagtcgtgtgacttacgaaattaccaaccttgtatcaccagctggaaccgatgctgtgaaactagttgtgccaaatgatcctaccgaaggcttcattgcctatcgaaatgacggaaatggtgactggcgaacagacaagatggagtttcgtgtagttgccaagtatttcttggaagacggttcacaagtcaccttctccaaagaaaagccaggagtcttcacgcattcttccctcaatcataatgacattggtctagaatatgtcaaagatacttctgggaaatttgtgccgattaatggttcaaccgttcaagtgactaatgaaggtctagcacgttctttgggttccaaccgtgcaagtgatttgaatttagctgaggaatgggataccacatcaagtcgttatgcttataaaggagctattgtctcaacggtcacatcaggaaatacctacactgtaacctttggccaaggcgatatgccacaggatgttggcttgtcatactggttcgccttaaacaccctaccagttgcacgtacagtaacaccgtatagtcctaaacctcatgtaacggtggaacttgaacccattccagaacctattacggtaacaccagatgtctttacgcctaaaacatttacaccagaaaagcctgtaacctttactccaaagcctttggaagaagtggtgcagcctagtctaactttgaccaaggtaaccttacctgtcaaacctattccaaaagaacttccaacgccaccacaagtacccactgtccattatcatgcgtaccgtttgacgacaactccagagattatgaaagaagtggtcaatagtgaccaagctaatcttcatgagaaaactgtcgcaaaagattcaacggtgatttatcccttaacagttgatgccttatcgcccaatcgtgcccaaacgactagtctcatttttgaggactacttgcctactggttacctatttgataaggaaacaacacaaaaagagaatggaaactatgtccttagctttgatgagactaagaattttgtgaccttaaccgcaaaggaaaacttgttgcaggaggtaaataaagatttaaccaaggtttatcaactgaacgctccaaaactctatggttctgttcaaaatgatggggcaacctattccaatagttacaaactccttttgaacaagggcacaaccaatacttacacagtcacttcaaatgttgtaacggttcgtacaccaggtgatggggagacaactacactcattacaccagataaaaacaatgaaaatgcggatggtgtcctcattaatgacacggtcgtagcccttggcacaaccaaccactaccgattgatttgggatttggaccagtataagggagatcgttctgctaaagagacaattgcacgaggcttcttctttgtggacgattacccagaggaagtgctagatgtggtggaaaatggcacggctgttactacccttgacggtcagaaggtatcaggaataacggttaaaaactatacttcactaaatgaagctcctaaagaccttcaagataaattagctcgtgccaagattacaccgacaggtgcctttcaagtctttttgccggatgacaaccaagccttttatgaccagtatgttcaaacaggaacttccttagctcttttgaccaaaatgacggtgaaagatagtctctatggtcaaactaagacctatacaaacaaggcttatcaagttgattttggcaatggctatgaaaccaaggaagtgaccaacacccttgtttctccagaacccaagaaacaaaacctaaacaaggataaagtggatatcaacgggaagcccatgctagtgggaactcaaaatcactatactctctcatgggacttggaccaataccgagggattaaagcagacaactctcagattgcacaaggtttttactttgtggatgattatccagaagaagctttattgccagatgaagcagctattcagtttgtcacatctgatggcaaaacagtttcaggaatcacggtgaaggcttattctcaattatcagaagctcctaaaacgctacaagaagccctttcgaaacaaaaaattcagcctcaaggagcttttcaagttttcatgcctgaggacccacaagccttttttgaatcttatgtgaccaagggggagaatattaccattgtcactccgatgacggttttggaaaccatgcttaattcagggaagtcttatgaaaacgtggcttatcaggtggactttgggcaagcctatgaaaccaacacggtgaccaattttgtccctaaagtaactccacataagtctaataccaatcaagaaggtatttcaattgatggaaagactgttcttccgaatacggtcaattattacaaaattgtcttggattacagtcaatacaaggacatggtcgtgacggatgatgttcttgccaagggattttacatggtagacgattacccagaagaagcccttaccctaaatcctgatggcattcaagttttggataaggatggcaatcgtgtatctggtatctctgtcagcacctacactagtttgtcagaagctccgaaagtcgtccaagatgccatggctaaacgtcagtttacacctaaaggagccattcaagttcttagtagcgatgatccaaaagccttttatgatacctatgtgaagactggtcaaaccttagttgtcacgcttccgatgacggtaaaaaatgagctgaccaaaacaggtggtcagtatgaaaatacagcctatcagattgattttggcttggcctatgtcacggaaacagtggtcaacaatgttcccaaattagacccacaaaaagatgtggtgatcgacttgtctcataaagatgtcagccttgatggtaaagaagtggccttgaatcaaacctttaactatcgtttggttggagcgatgattccaagcaatcgtgcgactgatttatttgaatatggttttgaagataactatgatgaaaagcatgatgagtacaatggtgtttaccgcagctatctgatgacggatgtcaccctcaaagacggttctgtcttaaaagaaggaacggaggttacgaaatataccttgcaacaagtggatacagaaaatggcctagtgtcaatttcatttgataaatccttcttagagactatctctgatgattcagcctttcaggcagatgtttacctgcagatgaaacggattgcgactggtcaggtggagaatacctaccttcatacagtgaatggctatgtcatcagctcaaatacagttgtaacacatacacctcaacctgaagaaccaagtccaaatcaaccctcaccacctcaaccaccgattgagtctcttgaaccacctgttccagcaagcgttttgccaaatacaggggaacaggaatccattttgggcttgattggagctggtattctacttggtacggcttatggactgaagaaaaaggaggagaagtagatgaatccaaaaactatttatgaaaaggattcagaccaagatggtttgacagatgctcaggaactagctttgggaaccaatccgcagtctgttgatacagatggtgatggtcaagctgatttagaagagctacaatctggacattcaccactagtcccacaaaaggagttgtgtgatggcttggaactttgacaccatgaaagaggctttgtctgaaatggagaaggtcgattaccaagagtttatcaaagcttttctctctttggaattaagtatttctaatagaacaatcctcaatcaggtttatcaagattatatggatgaagatgacctatccttgattagtgatgagctacgagataaagtggatagttatcaggatgaactacaggcagatatgactgacattctggaaaagctgtaccgaacaggtgaaggatctagttttattatggatttaatgtcttcaaatagtctttcagacaccttggaacagtatgaggttttggatagtgacgattattcaccacttagccttgaaaccttacaggccataattcaacaggaattggctatttccagtcaggattactttggagatttggttcaccttgccttgcaaaaagatttactagaccagaaaagtaatttcttacaacactatgtggcaactgtaatggaaggtattccacaagaaagagaccaacgagccttggtcctagattaacgcaaagggctgagaaacactctcagcctttttgaaatgggagggaataatgaatcaagaagtcttactacaaatgatgagagccaccattcctcgtgatagagccctgcttgaggcatttttatattaccaagcagagcattttgatgaggagtgggatagtcttattcgtcagtttttaaccaataggaaagaaattaagaaatctgttcaggtacttcactttgagacagatgtttcagcttttgtccaggctagtccttatgatactgctcatgatctattgacctatacacaagttttcggccaaagtggtctccaaaaactagacaaactatcgccgactgaaaaaaacttggtgatagaagtggccttgttcaatctggccactcgttttcaattattggattccaatggacactaccaaaccatatcgccggattcactcttacaaaagagtaggggagctaatttggtcaatgtgtatcgtgtggctaataatttagcggatcggatcagccgagatattgagcagtttctcttgacttacgagtctgagcttgaaacaggagttgatgaaacagttctagaaaatgaagcaactgttgatgagcacaaaacaagtgttcatcaagcaatatcttttagagaagatggctctttgattattgctagtttggatgtagatttgtctcaactagatgttcaaacaggaaaaaccagtcatctgcctgcctatgaagagttatctttacgacgtaaatttgagatactaacatattttgaccaaattcgaaatgaacgttccaaagtcccaagttttaaacgaggtgattttgacactgaaatggaaatgacaccaatctttgagggcgaggagttactcacctatctagaagctgatggtagtccctatgagttgaaaagaacattgactacagtcgaagaaaaggaattagaaaaaattggacgagccattaggatagaaaatcaagaaaaattgactcagctagggattgagctatctcagtttgaatcagaccaagtcggtattttattggatgcggcaggtcgttttcgtttgaaaaatgcggaccttgctttactaggtggctatcccaaagcctcggtaactcaactagcccttgcgacagaactactccaaatgggattgagtcatgaaaaggttgaatttttctttggtagccagctttccattgaagagctgcgacaagttgcctacgcctttttacaccaagaacttagcagagaagacgcggagcaatttgaaaaagataaaggcaatcagccagatttaaccctcagagattggaagaacaagctagagaaagctgagggaaaagaagtagttgatgaagcgtttgaggtaaatccacttgttcagatggttttggacaactatccgcttgggacgttggtttcctataaaggacaggactttgaagtgacgtcggtcagcgatgcacgattaaatggtttgattcgaattgagttggttaatgatttctccgatatcattgaacaaaatccagttctttatttgagaacatgggaggaaattagtcaggtgattcatatcccaaagccagaaccaaaagtagagttggacgaaccagaccaagagttgaatcttttttcatttctggaagaggaaacaagtcaatccgttaatgaagctgttcagaacattggagttttggatccagatggttcagaaaaaggtcataacgatactgatcttgaagatacagataatcaaattcctgaagaggaggtagtcgaaataattccagatagtccagtaacagacttccattttccagaagatttgacggtcttctatcctaagactgctagagataaggttgagacaaacatagctgctattcgtttggtgaaaatacttgaagcagaacgccgtaaagcaagtccgagtgaacaagaactgctggccaagtatgtaggctggggtggacttgccaatgaattttttgatgactataatccgaagttctcgaaggaacgtgaagaactcaaaaacttagtatcagataaagaatattcagatatgaaacagtcctcactgacggcttattacacggaccctgcccttatccgtcagatgtgggataagttggaaagagatggttttacgggtggtaaaatcctagatccttccatgggaactgggaatttctttgcggcaatgcccaaacacttaagagaaaagagtgagttatatggtgtggaattagataccattacaggagctattgccaaacaccttcacccgactagtcatattgaaattaaaggctttgagacggtagcttttaacgacaatagctttgatttagtgatttcaaatgtaccgtttgccaatatacgaattgcggataacaggtacaataagccttacatgattcatgattactttgtcaaaaagtcgcttgatttggtccatgatggcggacaagtagcgattatctcttccacaggaaccatggataagcgaacagaaaacatcttacaagatattcgtgagacaaccgagtttcttggcggggttcgactgcctgattctgcctttaaggccattgcaggaacgagtgtcacaacggatatgttattcttccagaaacacttggacaagggatatgtgacagatgacctagcctttttaggttccgttcgttatgacaaggatagtcgcatttggctcaatccttactttgatggaaaatacaatagccaagtgctaggaacctatgaagttagaaattttaacggtggaacactttctgttaaggggactagtgataacttgattgccagtgtccaaactgctctaaaccatgttaaggccccaagggagattgatagaaatgatatcatcattaacccaaatgtgttgaccgaacaagtcatggatacttccattccagctgaaataagggagaatctggggcagtacagttttggttaccagggttctacagtttactatcgtgataataaaggcattcgagtcggaaccaagacggaagaaatcagttactatgtcgatgaagagggtaacttcaaagcgtgggacaccaaacattctcaaaagcagattgatcgctttaatgccttagaagtgactgataacactgctctggatgtctatgtgaccgatgatgcagccaaacgtggtcagtttaagggttattataaaaagacagttttctatgaagctcctttgtctgataaagaagtggcacgaatcaaaggaatggtggacattcgaaatgcttaccaagaggtcattgccattcaacgccattatgactatgataagaagacctttagccacttgttaggcaaactaaatcgtacttatgatagctttgtcaaacgttatgggtatttgaatagtgctgtgaaccgcaatctttttgatagtgatgataagtattcgcttctggctagtttggaagatgaaagtctagatccaagtggaaagtctgttatctatactaaatcccttgcctttgaaaaggctctagtgcgtcctgaaaaagaggttaaaaaggtacatacagcccttgatgccttaaattccagtttggctgacggacgtggtgttgatttcgcttatatgatgtctatctatcaggttgaatcgaagatgactttgattgaggagttaggcgacctcattatgcctgatcctgagaagtatttgaatggggagctgtcctatgtttctcgccaagactttctgtcaggtgatgtcgtcactaagttagaagtggtggacctattcgtgaaacaagacgatcaggactttaactggcctcattatgcaggacttctagaaacagtcaaaccagcacgcattactttggcagacattgattatcgaatcggttcacgctggattcctttgtctgtttacggaaaatttgcccaagaaacctttatgggaaaagcttttgacctctctgaccaagaagtggtgactgtccttgaagtcagtcccattgatggagttattacttaccaatcaaagtttgcctacacctattccaacgcaacggataggagtctaggtgtccctgcttcacgctatgatagtggtcgtaaaatctttgaaaacctcctgaattccaatcaaccaaccattacaaaacaagttgtcgaaggggataagaaaaagaatgtgacggatgtagagaaaacaacagtcctgcgtgccaaggaaacacacctacaagaactctttcaagattttgtagcaaagtatccagaagtccaacagattattgaagacacctataataggctctacaatcgtacggtatcaaagacctatgacggtagtcatttaaccattgatggacttgctcagaatatctccttacgtcctcaccaaaagaatgccattcaacgaattgtcgaggaaaaacgtgctctactagcccacgaggtagggtctggaaaaaccttgaccatgcttggagctggtttcaaattgaaagaattggggatggtgcacaagcctctttatgtggttccttctagtttgactgctcagtttggtcaagaaatcatgaaatttttcccaaccaagaaagtctatgtgaccactaagaaagactttgccaaagccaaacgcaaacagtttgtatcacgtattatcacaggggactatgatgccattgtcattggggattcccagtttgagaaaataccgatgagtcgtgaaaaacaggtcacctatatcaatgacaaactcgagcaactccgagagatcaagctaggaagtgatagtgattatacagtgaaagaagcagagcgttcgattaagggattggaacaccagttggaagaacttcaaaaactagagcgagatacctttattgaatttgaaaaccttggcattgattttctctttgtggatgaggctcatcacttcaagaatatccgtccaattactggacttggaaatgtcgctggcattaccaacaccacttcaaaaaagaacgtagatatggagatgaaggtgagacaggttcaggcagaacatggagatagaaatgtcgtttttgcgacaggaacgccagtttctaactctataagtgaacttttcaccatgatgaattacattcaacccgatgtattggaacgataccaggtatcaaattttgactcctgggttggggcttttgggaatatcgaaaactcaatggaactagccccgacaggtgataagtaccaacctaagaaacggttcaagaaatttgtcaatctgcctgaactcatgcgaatctacaaggaaacagcagatattcaaacctcagacatgcttgatttaccagtaccagaagctaagattattgcggtggaaagcgagctaacgcaagctcagaaatactatttagaagagctggtagagcgttcggacgctatcaagtcaggtagtgttgatccaagtagagataacatgcttaagataacaggtgaagccagaaaactagctattgatatgcggttgattgaccctgcttattccttatcggataatcagaaaatccttcaagtagtcgataatgtcgaacgaatctaccgtgaaggagctggagacaaggcgactcagatgattttctcagatattggaactcctaaaagtaaggaagatggctttgatgtttacaatgaacttaaggacttgctagtcgatcgagggattccaaaagaagaaattgcctttgtccatgatgccaatactgatgagaagaaaaactcactgtctagaaaggtcaatagcggagaagtacggattctcatggcttcgactgaaaaaggtggaacgggtctaaacgtgcaatcacgcatgaaagctgttcaccatttagatgttccatggcgtccctcagacattgtccagcgaaatggtagattgattcgtcagggaaacatgcaccaggaggtagatatttatcactatattactaaagggagcttcgacaattacctctggcagacacaggaaaataagctcaaatacattacgcagataatgacctcaaaagatcctgtgagatcagctgaagacattgatgaacaaaccatgactgcttctgactttaaggctttagccactggtaatccctaccttaagctcaaaatggagttggaaaatgaactgacagttttagagaatcaaaaacgagcctttaatcgctccaaagacgagtatcgccataccatttcctatagcgagaagaacctccctatcatggaaaaacggttgagtcaatatgataaggatattgcccaatctttgacaacaaagtcgcaagattttgtcatgcgatttgacaatcaatcaatggataatcgttctgaagctggggactatctacgaaaactcattacctataaccgctcagagaccaaggaagtcaggacacttgccagctttagaggatttgatttaaaaatgactacacgaggtcttagtgagcccttaccagaaaccatttctttaatgattgtaggtgataaccagtatactgtcgcccttgacttgaaatcagacgtgggaaccattcaacggattagtaatgccattgaccatattatagatgaccaagaaaagacagaagggctggtaaaggatttaaaggataagctacgagtagccaaagtagaagttgagaaagtctttcccaaggaagaagattatcaacttgtaaaggctaagtatgacgttttggctcccttggttgaaaaagaagaagagattgaagtgatagatgcagctttggccaagtttagtgaagagacaacagcccaaatgaagcaacaaattgcactcgagatataagaaaaaaggctgacaaatatttttgaacgcggtaaaatgaagtcaagaaatcacaaaaggagaatagatcatgacccaaacactagaagaaatgcgttatcaacttgaagaatggttggcacaaggctatacaagtccagaagatagggcaaactaccaaaacttaaaggaacagtatgaagatgaaactcttgattatagcttttcaaggcgtgaaatcactggacagctggaactcatcatcacaagtcgtgagaatgattttccaaacttagatgaggtgacgaaggcagaataccttgatttggttgcccaacttgatgatttagacaagagacaggctgactattatcgcaagcaattagcctagaaagaggtgtaagatgttggagcaaattctacaaagccttttgattatcgcagcaataggactgatgttgcttgtcctttatcagattgtgaaagtttcaggtgctttgtttcttatcggactcatcagtggattagtctttatagaaatctatggaatttacctcttttttactgagagatatctctattcagaagatttagcaactaatggaatttggagttttacaggattttttattatttttaatattctgctagtgcttggactgatgaccaacctcgtgaaaagtagaattacggaatacaaatagggctacctgattctaggtagtcttttatttttgtctgtttttgattaagtgtagatagatgaaattggattataggaacttagtatctctttttgtcttgattgtgatacgtgtgtatatatttgagtaatcgaaatagaactgtgtccaagtatctgctggatgtaccgaatatcgacatcattatctaataacatagtagcaaagctgtgacgaaacatatgaggtgtaatagttgtagtgagtctggtttgtgttttagctgtttttagaagcaaacgaacactttgttctgtcagtggtttttgtagggattttccgggaaataaataatcgtctgtatgattacaataacaagtgatataagcttttaataactgaaaagttcgttcatccccaataaaaatcatacgctcttttttaccttttcctagaatttggagtgtttgttcagtgagattgatatccttgatttgaatatgacacagctcagaaatccgaatgccagtagaaagtaatagggagacaattaacaaatttctctcagctttctgtttttgataaatagttttggctgagatcatcttcttttgtagataggtatagaggatttttaaactatcgtgagagattgtcttcggcaatgttttttctgctcgaaattgaaaccgtaattgattaaagggattgtcggtaataacatttttcaattgaagatagccatagaacacttttaaacttgcgatttttcgccgtaaagtactagtctttaagtttgaatgtgtcaaaccttcaatataacttatcacacattcgttattggaattgtaaaattgcattaaatcatttttataagcacgcagggtgtgtgtactcaagcgtttatgagctttacaataatccaagtagttagaaataatagtataatccatgatagtctcctttatcgataatgacgctattatagactgattttggtgctttgtatagtgataattaatagttatcggtaggagaatatttatgaagttagtagttattttgaatgttaatccagatccaaatgttcatgaaaaaattagtgataatagagaatatactcgtcgagaattgaaaaatatattaaaggaaaacttttcaaaatttgttaaagaagtaacattctatgataattttgaacatttcaaaataaatgttcaaaaacaccataatgattttgtattaaattttgattttggatacaaaagtagaactagaaatatgaatgtaccagcattctgtgaaaactataatattaagtatttcaaccccgatccctatgtacaagttttgtgccaggataaatttatgacagagaaatttgctgaaaattttggggttacagttccaaatagtttattagtatttaaacattcatatcaaaaaaacttattaaaagacttaaattatccacttattatcaagccaaattatgaatctgaatcaatcggtattacacaagattcaattgttgaaaatccaggagatgctgatacaatcattggtaaactatttaaagagtttgatgggattttggttgaagaatatattgaaggtaaagaagtagcaataactatttgggataatggtgaggagatattttttgaagaggtagagcttatttttcccagattagaagaaataaaatatcaagcttatacatcagaaataaaacaaaaaatcggaatagaaatcaaaaaaagctgctatttaagtgataaagatattatcaacttaaagcaactttataaaaacttgtctccgaataaactaataaggatagatggtagaataaaaaattcaaagttttatttaattgaaatcaatgcaaatcctgggttatatccaaaatctgttgtacccaaaacttttcttataaatggatatgattatgaaactatgttaaagaaactttttagtgtccatctaaactaagtggtaatttccacgaagtttcatacatcaatctcacattgtactctttaaaatttttaatttgatggtgcgtcaatttattgttgtatacctctgctttatcaacattatacattttattataataatgatagagattatagtagattttatcaacaaatcgtttaaaaccagtctcatttaataactcttctaattccagtacaagcatttgacaattaatatctgctactcgctcacttagaatgtaataaacaagtaaattattataaattgccaacaaatcatattgatcataagcagttaacttagcattattgagtaattctgggatagattcatcaatgtcattgttatgaaatttaatagtagcctcattatgaagaatcatatgattataaataagtttctctccaaaaaaatatctggctttatctaaatgttcctctgcattcatgattttaccattgactgcatacaggtatgaaagatagatggcatttagaccagagaattctgcattaccctgattataaattctatcagaaatttcttcaaccatccgtaatcgttcagaaaagctggattcaaatacatttgaaattctaattaaaaaagggtagtacggattatctacttgcgatttaatactttcaaagattgttttagcctcatctctacgctccaattgtattaaattcattagtttaatcaaggataatttgaaaaattgtgaactttgctcactaagacttgtaatatttttctgaatgtatgctatggattcaataaatagttcacaacggtttaaaattagggacttagcaaatattacatcatctgtaacttttgacgatagattgataaactctagcgcctcatggtataagttggcatcataagctattttagtgaatgaaagcgcaaaggaattatctttctcaataaatctctgtctattcaagaaaaatttttcaaaatattctcttcgtccttgttgtgaatcaaagttcaataaacgttctcgtatttgaggtattattggtttaatttgtaacaaattctttgaatcaatatagtaatcaacaagtgtgtccaagtactcaaatttatttgttttggaaatttttaagttaagaaatcttatgagacttgagccaacaaaagctttctctgttctgaaataactctcttgtcttactatttctgaaacggagtttggcaggaaaacaaaattttcaacttgctctaataggtttttttcaataagaaacaaagtataaatttctaattatctttttatattttcttaaatgctcgtaaagccttattctatgtgctttcgagtatttttactgtaggaagatacttcacgtttctttgcatatttcctcatgtcttagctgtcagaagtggtaaataagtagtaaattcatttgtactactaagcaacaagacgctcctgttgcttctctttattcaagcgtttcatttctgccattgcagaatcgaatgttgcatgtgcgtaatagttcagcgtcatggctatattagcatgtcccataatgtactgtaatgcctttggattcattcctgcatttgcatagttggtacagaatgtatgtcgcaaactatgtggagtgatgtgtggcaatttatcctcgttatacttattgtatttcttaacaagacctttcatcatgccgttgtaatcacttgccacttttggatagttctttctattaagaaagaggaaatcactatatccatcaatctcaacacgcttatcattctttcgattcgctaacactcgcttaaatgcttgataggcttcttcaaccataggaacttgacgttcgccacttttggtctttggtgtttcaatgtagtacccaatttcagtatctctcaatagctgatggtctatattgacaagacgattctcaaaatctaaatctggaagtgtcaaaccaccaaactctgaaatacgaagacctgtttttaagagtatcagaatttcatcataatttttgctgtaggttttatcagcttttgcaaaggctaacagtttttcttcctgttcttctgttagtacggtcttagggacagtatcatcatcaagaactgctttcagttgaaagtcaaatggattcttccgaacacaatcatcttgtatagcaatatagaatgaagcctttaaagaacgtttgtagttattgatggtttgataagcataaccattttcactcattctaatagcccattctttagcgtctgatggcttaatactgtcaatacttcttacacctaacttgtctttcttcaaaatatccataagatatttgcgtccagtttcagtgttttttctaacctttggtctttgagcgttctgttttgcgtaaagctggcagagtgtcattttctttcctacaacatcaataccatcatgaatgtctttctgtaactctgcgattttctctctaagtgagatacaatcacgctttcctgctggtactcggtctgtagccacaagtttccacgagtaaacaaattgcggttctccaaatgaatctatatatttgtataagtatcttccgtcttttcgttggctctctccagtctttaagattcgacctttattgtcacgtcttttttctgacatggcatttgctcctttcctttatggaaagagccttgatacgacttaatactattttatcatatacaagaccctttggcgacgctagattgcgtccaatgtatctataattttttcaaattgttttcgtttaatctgaatacgattgccattcataatcagccaatttgcatttttattttcctctgccaagcgtcgtagcttgttttcgccaatacgaaaatattttgacgcttcttcaatggttagggtataacgttcccaaataggaatgtcagtctgcttcataaaatcctcctttccaaatcacttatttggatttcataaaagttgttttaccagcaatcgaacagctttagcaaagctcacgggagttccacccctgcatggttctcatgtagccatactcattgcctgcgacggttttatcacgctcggactattgactgtatgggagtatcattatcacgataagaatgtcgttgcaggcaatcctgctaaagattgcttctcggatcactaacatgaatcgctcgctatctttataagataggtcatggcggttagttccgttggctcttttcttatcgaaacgtattcgattacttttattcagttttcaaagaacaatggctcgttagcctatcaaaacacattgaaagctcaatatgctttggtggaataacaaacctccctgttcgggaagcgtggaatggtttagcacgcttccacgaaaggagagaggatattacttaatttcaaatgacaaaatctttgtaatcagtctggtttccattcttccacgtaagacttcatcaacgaccatactttgattgccatattcatctttcataagtcgtagggaacgcttcgttatgtaccctctgtaatgatgtagaatctggttaatcgcttcggtatcgccatctgttgcctttacaatgagaggaaagggaatcataggatattgtgttttcattcttcaaattcctccataaactttttaattaaggctagtccactggttctatgccgatagacagtagaacggttcaatttcaacaggtctgcaatttctgaatcgctcatgtccataaagtaaaacagcagtagaatttcacgtttcttgtctggcaactcacgtaatgcttcactcaacaaatcattttcaacgcctactgataacccattgagtgtaaaaatctgaaagtcagttgaatagttatctgttgtcgcaaactggctaacaagataatcgccaacatccgaaaaggacacctcacgctttgcaatccttgaaagataaagcatataattctttcgctcgtcttccatagcacgtttacagatatagtcaaactgattttctattgtggtctgaaaagaagatggtttcatgtttctcaccccctttctgtctaggaaaggaagtgagccttgctcgtttatctcctttcactcttagtcccaatgtgaaagggggatttgttgcattactgataaataaactttgtaaaaaagttctgaatagccaaaaaagcatataaacagatttatttctctgtttacatgcttctgttattctatctatatgatttataaaaccacattggtggacgtacttatctattgcagatagacgactttttttgacaagaacccaatgtaaggaaatttattgtatatgatgtacttcatggcgacgttgacctccaacaaaccgccatttggaagtaatatacaatattttaacagcgtaaatagcactaccatataacggttttttttattggcgtttagtagtgctttttattaaatataaacctataaaccatataacacgtttttctatacctgtttttaattcagtaggaacaataaaatgtatagaggtggtctactatgcgtaaaaaagaagataaatatgattttagagcctttggtttagccattaaagaagctcgattgaaacgaggtttaactcgtgaacaagtgggagcattgattgaaattgacccacggtacttaactaatattgaaaataaagggcaacaccccagcatacaagttctttatgaccttgtatcgttacttcatgtttccgttgatgaatttttcttacctgctaataacttggtaaaaagcacccgacgattacagatagagaaatacatggatagctttacagacaaagaactatccttaatggaatctttagccagcggtatcaacgaagcaagaaacatcgaagactaattaaaagaatccatacataacggaaagagccgataaaatgagattgtattaatctcattttatcggctctgcgtctttgcgtctggctctgtaatcacagttactttgaactgctttatttcaattaaattttcttgtctgcatttcggacaatagagggggaatttttttaattcagtatcttcccttatctttaatcgtgttttatttccacatacaggacacaatatccacttgtagtttataataactatctcctcctttacactttaattcaaatctttattaaaaaatatttcatcttatttaacaagaaaccatatttatataacaacataaaatacactaagttattttattgaacatatatcgtactttatctatccgactatttggacgacggggctggcaaacaggttcaccggtagtaacatggtacccttttaactctgttaaacaaacactacgtccatttgtaaagaaagttaaatcactacgatattcttgaatacaccgagcagggatttctccactaagaatgacctcattatttttcaattgagtgtctacgatgttcgcacaatatttaggagcatcgttgtatgctcgtgaaagatattcctgtggcgcataaattttaaaactaagatatggctctaacaattctgttccagctttttttaagacttgttccaatacaataggagcaagcatccgaaaatctgctggggtactaacagggctatagtataagccatacttaaaacagattttacagtccgtcacattccaaccatacaatccttgttcacagccatagcgtatcccctccataactgcattttgaaacgattgatttaagtatccaagagaaaccgagctctcatactgcattccacttcccaacggaagcggtgatacagataaaccaatggaagcccagaaaggatttggcggcacttcgatgtgaatggtatattctgcattttttaacggtctctccatataaatgactgtaggctcttttagttctatctccacatgatacttttcttgcaacagtgcactaatcacttccatttgtactttccctaagaaagaaagtataatttcatgtgtcgtagaatccacgtaatatcgtagaagcggatcactatctgagatttccaaaagggcatcaagcaacatttctctctgttcaggtttactcggttcaacagttgtttgtagtagagggtgcggattttcaatcttttttctctgtggcaatagttttgtatctccaagaacactatttaacttcaaaaactcattctgcaaaataacaatttccccggaataagccttatcgattttacataattcaccatttattgaagtatacatttctgtaacttttattttttctttttctgatactctaaccgaatctcgtaaatgtagtactccactataaaggcgtatatatgcaagacgttgtcttttttttgtatattcaattttgaaaacatttccgcaaagttcagactgacctcgatgtgttgatgaataaaatttattagtaataacttctataaggttatcaatccctatattactttttgcacttccatgataaagagggaacagagaacaattctgaaatcttatgctttcctcttgttcgagttccaatgcttctaatgatttaccggacatatatttctctaaaaggtcatcgtttccctctattaccgtatcccattgttcagattcggtaaagttcgtcacacacatattaggatacagttctaccttctgtttgattacaatttcggcagaaagtttctctttaatatcctgataaaccgttgataaatcaattccattttggtcaatcttattgataaaaaagattgtgggaatccccattttcctaagtgcatgaaataatatacgagtttgtgcttgtacgccatcttttgcagaaatcagtagaattgccccatctaaaactgataatgaacgatatacttctgctaagaaatccatatgtcctggcgtgtctatgatgttcaccttcgtattttcccactgaaaagaggttattcctgtctgaattgtaattcctctctgacgttctaaaagcgtattatccgtcctcgttgtacctttgtccacgcttcctaattctgtaatcgctccactgttatataataagctttctgttaaggtagtttttcctgcatcaacatgagctaaaactccaatattaataattttcatgtgattttcctccattcaaaaacccaaaagggcataaaaatcccagtgataaatacttttatcactgggatttttatgcataaccataggtatacaaagcatacagatattctctggatactttagaatcacatgataaaggtattcttaaactgggtacaaaaaactaagccctcctaaaaaaggacatccaattatttgttcccactatcaaattgacagtttatttaagaataccttgccgcatatttattaactccttttaaatagatacttaaataatagcacgtaagagcatatttgtaaaggaatctccaattttttatcaaagagagtacgtgattacaaaatagctgtaataatgtaccaatatttgttattctataatcttccaattactcccgttcttttcaagtaccaaatcaaattgagatacctgcgttgctttggtctgctggtcgatatactccactgtcagcgataccgtgacttgattatccttacgattgtgaataggatttaccagttcttgaaagatgtactcttttccgattggttttaatatcccgtcattcacatagtaggaaagttcactggctgtcgctgtaggatagagcttgaagaacgtcgttaaaaactcattgatttcattggttgtaatggaatcaaccgtcccctcactttcaatggcttttggtttataacttgatttcttaggtatgttggtaatggtcggattcttaaccagtaccatatttccagaaccatctacatagacactcactatataagcagagtggacggtctttgtattttctccctctgtaatgagctggtctacactgtaggttacattaaactcattgtcgccagttggctctaccgtccatatctgaaatcctcttacagaagacgatacaggaatatctttgcgtactgtatcaacattgagagcttgaagttcatctgtcagatagccttttagactttccattcgattatcaatggacttatcggattgctcccatgaatagtagactttcgcaaagttctctacaaaattttctacatgatgagtatcaacgtattccttttctatgatagttgtttcgtgaatagtatgagtatctatagctgtaaagtgcttgaatatcgcaaagctgaaactaagccctaaaagtacccacaaggcaatcacaacctttttatgaggattgaccttatagacacgaggtttcttttcctttggtatctgtttttctttattctgattttttctaaatttcatcattaaatcttcctttctcattgtttgattcgtcctgctcccactaaatgctgttgccagtaggggcttgttaagtcggcataaccgattgggtcgcctgcatgaaacatacggttattgccaaggtatatcccaacatgagtaatataagagccagcgttataggtagaatgaaagaaaaccaaatcgccagcttgtgcttccgatagtgggatatgctgggtcacatcatattgctgttgtgcggttcgtggtaagttaattccagcttttccatacgtccattgtgtcagtccgctacaatcaaaagaagtagtcggggaagctccaccgtaaacgtatcgccagccctcatatttcagtgcttcgtccatgatggcttgtaccgtatcatcatcaaactctgttgtgacaagatactgcgttaccagttgcacataaaacatattgccatagttgtatcgccagcccccattgataggtatggctatgggattggggtaagacactttttcgccacctgaatactcttttgagaaactttgagccagttcaaaggtatatttatttccacgattagccacataccctaagaaaccaccaccataattgtaggactggataaccgattctaaatctacactgagcctttcgctactggctaataattcactgaaatacttcacaccttgcttaatggattcttctgtactcaatgaattaggtggaagaccgagggattccgaggactgcataacatcttccgcagtaccgcccgattccacctgtataatcgcaagaagtatgttgacatattcttcaacgccatattctttggcatatttttctaccataggcttatgagccagcacttctgcggaaacattcacacctccataatgaatattggaaattccgctgtcctgttcatctgaaaataaaatggcaacaaacagaagcagtgagaagaccatcaagaataatccagaaccaccaatcactaaagttttcaacttcatggtttcttaccgactttcttaatggtggcggttttgattggtggtctacttcttgtattttgtagtggtactctttgaacagtagacggacgttcttttgtgattggacgttgtgaagttctatctgctgtagtggttgaagttgctggcttttgaacggttttttcttgaacggtattgccttggcgttccacttttggacttgaaaaatcggacttaactgctggacgctcttgtttggcttgttgagattccttatatgaagtctgaatattagactgttttgaggtctgttcatcatgatattgttcttgtcttgtagtcggtctttcatgaacagaagaagcaggctgttttttctgtttgacctgttccatttcagagcgacgcttcgcaatggtttttcgcctttgttcctgctgttccttgcgtccactggctctgtccgctttggtttgagaaatactactggttaaatcacggacattctcttttactttggattttccttgatatactgcatatcttgcattggtcggcaaatctttaacctgttctttcaaaccactagcagtgtctaccattctgtctttggtatcagctactgtaccgatggtttgaccgatacgttttccaagtgttgatttttcctttccgtctggtcgggagtgatctgcttgtgtccttgcagaactccccgaacccgactgtccttttttacctgtaacaatggcagacccagcccctagagtagtcatggaacgtccaagtttccgctgtagacggtgcatgtgagcgtgcataagcatacgaggttttctcatcacacgacttcccacactttgagaatcgttactctgtagagaaaacatactcattaaatcgcccagcttgaagtagattcctgcaaaggtcacaatctgtagaaaagcaatcaaaaagaacggataaccagccgataaggtatagagcatggttgaaatactaaatgctgtcgtaataatcaatgtgattccagctcgtgtcaaaatggtattaaagagctttgttatggctcgttttgacataccatcaaatgatggaatcatgcttaaaataaagctcacaggcagaaacatagcatagatgataaaaagtacctgcgagaaaatcatgattcctgttaataggaatacaaatatggaaatcccaatattgaagacaaataggaagaagactgtacctaaacggttaatggtctttgtaatggttagattggtattgcttctgtcttcaatttcttccgcaacaattttttctctgtcttcgccattgttggaatctgggctggtggagagcaggctttccacacggtcaataccgatactttcaatgtctgaactgttgtattgaagcagtagccacggttgctgaacctgtatggaaaacaggctatctctgattaagtccacgctgtccttgccttgactatcggaatggggcatgacaatcttcgtgccaagtgataaactggcattactgatgtctgatgaaaagtcattgatttttttaatgtagtcgggagcgtaggcaataaaggaagccgataggataaacaccagcacaaaattcataatggcatgaattgcctttgtggtttctctctttatcagtcccgtataggcaacataaaccccaagaaccaaaatcaagagtaagaggaatccaacatagaaaccctctgttgaaaatccgtttgcactcacaccagctaaggtctgcatattcttaccaatggaatctgctgtagcggaaatgaagtctaaggaataggcttcctgtactaagtaacctgtcgcattggaaacatacaaactgattgtccaaataaaattggtaatggcatatagtccatacatgacctgttttccaatcccgtccgaccagttccacggaagccagccccagctattatccacataaaaatccagttgatagttttcaagtgggtatcggctgtattcatttgccacattgaccgtatcatctaccaagcccgcagcttgaaccaccgttcccagcatggctaaaagaaaaatggcaatcacaagtgtgaaagccactgtcattgccactttacctagacgtttcagcgtccagtttgattttattctgtttactattgatggtttcacatttacacctcttttcgcacaggtggtctggtatcaaaggcatggagcagttcttcaaatacagggtggaactgtatcacaccgacacgaccatataaatcactgataaggcattgcccgttttccaaatcacgcaatcgcttctgattgttttcgtcctctgggtctacaccaaaaaaggctaaggtctttttaatctcgttaaggtcagtggaacgaaatgcaaattttaagccgaggttatttttcagtttttcatctaagaggtcgtctgtattttgggtcacgaaatataccccagcgttcatagcacgaccagcccgaaccagcttcatagatagtgtttttccttgtgctacctgtaaaaagctccatgcttcgtctaaatctacaatcttgaaaatgcttcggtctgtatggataaagtctaaagcaaaggtactaatgacaatcagcatagcaacggataaaagctccatagtggtatattcctcaaaggaagtttccttgtcgggaagtaccaagtccgcaacctgtataatgttcagttgtttttctaagctgatagactgctccacataaccattactgaataataaatgtgcaaagtcatagtctgtaaaactttcgatatggtcggctatactggtacttagtggcgtattctcaacccgtaattcctcaatcactttcatcaaccctcgtacttcactattggttactgcacgaatggcttttctaaggattgggaagcgttccccatcacgagaggaaatccccgtaagaaatgtcagaatatcaatagccagtgattcagaatctttgggatttttcataatcacataagggtcaagtaagcctttgtttttctcatcagaagtcagagtgacgatattgatttcatgggaaatctctggcaaggtttctttccatctgccacgttctgcttttgggtctacaatcactgcttgtgccccataaagcaccgcataatagacgataaggttattcgcaaaggatttaccaccacccagcgaaccaacaaaagccgacgctaacgcattggttactgaacccttaaccccttgactggcaagagcaggtttcagatagacattgcgtccagtatctaagctgtagccaacataaatcccctcattttcccccagcatttgagtagcaccaaaacctaaaccagcgaggaaatcagaggtcacgtattgaatataatcattcatataacgcttgctggcaggtaaaaattcttcatgtaagccgagcatatccccaaatggtcgtaccagttttacgcttaaatcgtcataaaaatctttcacttcattacaacgacgtttgagttcgtcaagatcatttgctgatacccttaccacataagacagcttgtacatagattccttgctttggtctaaattggtttccagctcattcacactttccagagcttccgccacattggagctggtttcattatcactttgccaagcgtggttatccaagtctttcagttctttctttttattgcggacagtagatagggctttacgattcgctacaatttccacattcattgacgtatcaatcgggaatgtaaattgctgttgctggtagtagaagatttcagaggacgggaagtccagttctccgacaatgctgttaatggtaaagtaagctacatagacggtttcatcttcctgctggattttcaaatatcgctgtttttcttccaccaaacagcgagtaggcttaatcaagtcatagtatttaatcagcgtttcattatccagctttttctttgatagatggtactcatactcttcataggcagtgcctgtctgtccgtaaaggtgttcaatcagatagccgaagtcgtccttatctaacctgcggattttgaaacgacgagagattttattttctaagagcttttccatcttctgaaaacgcaggatttcatcattactcatactaacaaaatcgcccatcagcttatggttcacatcatagacaaaatcagacaaagcattttttgcttcaacggtaagacttttcatagaaaactcctgatcgttgagaagcaacttaaagccgataaagaaacggtagttcacttgattttcgccaatcatggatattaaagcgtctgtctgttggtcgattttgtcataggcaaccgctttgagcttgccagtgacttcatttttggaacgctcttgtgcagaacgtatgctggattctgtactgatttgtaaagcatgaattttgccatcacgattttgtgcgataagctgtctgaaagaatcatgcacttgtattttctgttctggacttagaaatgagtaattgtaaggaacaagctcatagtaagcataacattccccgtctttattccagacgagattgttttcaatgtatttaattggatatgccataaaattcactcctaactgctgtaatggcttcttgtggctggtttctgccaagcgttactttttttcctgcataggtcagctttggtcgcagtgcataagcaatgacagacttcaaaaatccataaggctttttaccatcaaaagtttttgtagacataaaccatgtgaaagccacaggaatcccaaagtatttgagaaatgctccctctatcatggaaagagggggcaagttgccaagtatcatcactgcaaagagtgacacgacaaaccatgtcatttgcgtaaaggttatgggaaacggaagtctaaaatcattgatagaatacagtaccttttccacagaccagatactggtatagcttcgtattttcttcatgtaatcaatcctttcataaaaaataggggtagctgattgagccaccccgtaaaatagaaaatctgccagtagtaatgtaccgacagatttaatagacgatttcaaaaatcccatgattggttgagataaacgttcctgaaaggtctaaatcccgaccataggcttgataatcaatatagttttgaagactagctggtacttcgcctaaagcacccgtttcttcaatgtagtagcgtgccacgtcatacatatcatcacaatcggaatgaatgataatatcctcttgatgttcgcttagttcttcaatgcttgaaaaatgagtgagcagagcagatagctccgattgtaattcttcgggtaattccgataccatttcccatagtcgattgagttcgccaatggaagtgtattcgtcaaccgtaaagggtaactcgtagtcatgaatggcgtattcctcatattcatcattcaagccgattttctctttgacttcctcaaagtcaatgggaaaggtaaaccacgcaccgaccaattcgccctcattgtatttgcctaaattcgcaatatagacttgcatatcgtccatatattcacgtcctttctttgtagagattcaaaaatccctaccgcacttcgtttggtgtaccattcctttgcggaacataagaaaaccacttatattccacaaaagaacggttttatttaagcaccaataatgcgattgaatagctctagtaaaatgtcttttactccagcagcgttgaagactaagccaaccgcaataatcgcaataattaaaaagccaatcagtttgctaaactcacgcttgaagccaagatacaagccaatcacaacgattgctaaaagcaccagtgattgagcgtttgatagaaaccagttataaaggttttgtccaaaattcataaaaatgttctcctctctatattcaatgaatttgtatttgagttatttttttgttgttatcacgtcctgttcttttactgactgttgcttcaaaatctgcttgtgtcggtctgtcagtttcgcatggtcgagaatgtcttttacaacctgcgtctggttgatttcatcaagtttaatcgcaacctttaaggtcggggcaacttgatgagatagccagttcagcgtcctttggaaggagtaaggctctggttttgtggttagttttaatcgttcacgattgttcccaataaaccaagcccattcttcattcagtttccaatcagaacgaggtttggaatcgtctttatctacaaaacggatataccgattgataattttaaaggcggtatgctctggattgtcatagacgagtaaatcacggactgcataataggcacgctcatttttcaatcgaatctcaaaacggttttttacttctgcgtcttcaatgggaatatcatttttcttgtactgctcgtagtccttttcatagatacagaaataaacttcactttgtaatgaaccgatatagagggtgtttcccatacattccttttcctctttgcgtaccagttcgccactgcgatagcttttaaaactgcggaagacggagatacattcttcctgttggcacttttcagtgagtacagggatatttaaaatccctgtcttatcgttaatggcaaggtcaaggcgtttcatcacaccgccagccaccaaaacgtccataaagaactcataccagcttctttgttgtgccagaagatagctttcaaattgtctgcacccacgacctttcaattccaccagaactcctttgtccagttcatgggagcaaaggacgaatatgtcgcctaaagcataatgctctgaataagaatagaaaccatagtcctcatgaagaaaataggacagtttcagttgtaagatgttttcgaccacctgctgtacgtctgttgtcggaaagcgaattcttacataatcaaacagcatttcaaggggagcgtcgggattgaagcgttccagagcttcccaaagggactgctgtaaatcctctgatggcttgacttttcctgtttcaatatcgcttagatactgccttgtaataccagtcgcaacagctaaacggttttgagatagtccataagccaagcgtttttcttttaaatgctgtaaccaagtttgttcattcagtaaaaatccctccaatcaaaaaggcgtatgtcaacttttaaagcccatttgacatacgctgaaattttgtaaatcccttgtaaccaaaggattttctaatgtttttttgactgtttcctgtcgatttgtacccccctgttagatacggggggttaagtgctggcgtggctattgccacaccagccagcaagatcagtccacacctgcgacttccgcttcgcacgtcgcctgcgtggactgtctgctgttggataactttttaatttcctccaagaaatcatatccttttggtacaaggggagtataaaactctgatatgacacttgttcctacatcaacatagccacgacctttgattcgctttaagaagaaatccttttgtacgtcactgccaaacatcatgccatagcccatttcagacatacgacctaaagccactctgaaattaaactgatcacggattccgtcgcctaaatattttgcgtctggacgttgacaagccagtattagaaagaagccagcttgacgacctaacatgacaatctgtttcagcttattcataactgcggtgttttcttttgttcccagcatttccatgaaagcgacgtattcatcaaagattaagaagtgtgccgggagacctaagtaagcataatttttgccagtcttatagttcttcatctgcttcatttcctcactacgtttcatcatttcttcatagaatgtttcaatgcaagaaagcaagtcttcttttctatagtagacatttgccatcacagaacctaagtccgcaagatcagcatttttcgggtcaagaatatacagttttgaatctgtatgaagcaaggcttcaatcagtgtcagtataaagtaagttttaccgccacctgtaccaccagcaatcaacatatgagggagcttatcatattcccaccatacgtttttcattaagcgaagtttaccatctttagcttctacttcatcaatagaaatacgactggctatggtgtcatagagcaaagtatattccacataggaatcctttaactctttatccgtcagctcacagtacaagccactctctaatttcttttccaagtgtaagagttggtcttgatattttcccagcgtgatttccacccgtatctgtatcaagccatttttaagtcgataatacattttagggaagtaggttatcttttcctttgtacgaccagcactatctttaaagaaaccctctgttttgacctgttcagattcataccacttgttttcaagtatcatctttgccagtttttgacggtggtaaagttgtttaaccgtatcatagcgaacccgtttgaatacaaacgctaccagcaagcagataagaattgcgacactgaaactgataattaaatagggaatgtcaatcttatctgcttgtgataggttaaaatcctgccagttgatctgctggattgtcttcacatgaaacagtccgacaaccagcaggaaaacaggcaggagtgacgctatcgtaaaatgaaagactaaatctttaccagatgggcgaatccttttaccacgctgtttcatgcgaaaaagtctcctttctacctagcgactatttgtcttgtgtcggttctttctttgcttgtggttgagctttgaatgaactagaatcctttgtcagcacaatatcgtctgccttgatataccagtcaacatctgctccttgataggtggcagtagcaacggtgtccgcaatgggattgataagttccacccgtgcgttataatcaaactctttcaaaggcacgctggcaggaatacttacttgaatcatgcgtccttgtcctttggattttaagtcataggtacgttccttgatttcatctgaaaccgacccgtcttcattttggattctcacttcacgacgtagagcagagaatttcaattctccaaaagtcgtgtctttatctaatacaatgccatttgctaatctcatcatttttcctctctttctttattcttttatcatgtcgtcagcatgtaaaaggtaatttgtaaaaccacgagtgccgattttgtagccctctgcggtaatacgtggattgactaacttcacacgttcctcaaagccgaaatgtttttcgccagcttcagcaggaagcaccaccacaatatcatctgctctttgaacatcagaatagagattatagcttcttgataagacagttagccgtccgttgattcttcgctgaacgactttatcctcgccagcaaattctaaattgccgaatgttttttccatgttgggaatcacaaatttaagttccatatttttacctatcctttcttttttattggctgaatgaatgtttgatggtcttaaagagtggggaacgaccttttgattcttgattttttgttttcataagttcacttcctttcaaaatcgggtaaaaaaatagacacctcattttttgaagtgtctacctattaaatattcaaattttattggaagtatctttatatcttcacttttcaaggataaatcgtcgtatcaaagctcattcataagtagtaaattagtagtaaattgagtggttttgaccttgataaagtgtgataagtccagtttttatgcggataactagatttttatgctatttttaaaaagaaaatcaacgtcatctgatgagaaagttttatctgtctctagcataatttcttttaattctttaagttgcaattttccctttgtgtagagagtaagaattaaaaacaccaattgggtccgagagatattttcaatgatttggtagatgctctgtagttgggaggcattatcttccttcaaccgctcagaaaagtcttttaatataatggagatttctgataaatctccttttcttatactgtcctgtaaaaccataaaatcaacttgttcaatttgtaaacctaattgttctgacaaaagatttatatatagcttgatgtgctcctctgaaagtttctctaattgatatgtttttaaagttatattgcaactatttttaaaactattttcaatcttttcatctgcacattcaaaaatgaagatacttcctttggattttataattaatttgtttaataaatcaagtgattcttgttcgattttggatgcgtttggaaaattaaaatataaatttgagtgatctagaacgtattttgcatattcaaatagattttcagtttgagcttttaatataaatgtttcgtattctctatgttctactactagtgaaggtaaattaaattcggaggctaaaaattctaaaccgttttcttgggctttcttcacaagaactgcttgtccaaagaaggaagatatttttaagagtagttgcatagcctttgaactattaatttttctttgataaaaagatttaaaatcaagatatttattggagtagcttaatttatctaattcaatgacaaatcgtctgaatgtggaaaattcttcagtatcttctaaatgaagaatttcaatagggatttttgaaaagcccttagtaatttcttttataaattctgacttcccgatacctgaactggctctaataatataaatatggctattacctgtttttaaatgttgtttatattcattttttagttcctgcaacaaatgtttccgattaataaattccattattgaattctcctaccgataactattaattatcactagtataccataatttgtagttaatcatatttttcttgtgataaaatttccaacttaatcttgatatgatgaggctatcactaataaaggagtaagccatgttgaataaagtgaaagctcgatttctgattggagtcggaggtttaatcgcagtcagttttatggttatgattggctacacgattggctcacaaaccatttcaaagcaaacagagaaccaaatacgagcagaagccaataaacttgtgtcaaagaaaaagcaggaggaaagagcgacagtcctatcagatgagcttgtcaaagaatttctcactcaatatttcaccaaggttcagctgggtgaaaataacgctcgtatcaagccctacatgacggattcggcattttcagaagaggaagcaaggcagaataaagcgatcaatcaagtttataaagactatatgcttgactaccgatttgaatcagccagtatctatgtcaatacagaaagccatgttgcacttgcggaagtttcctatcaagtaacttatgtttctgatttgagtgagcaacaacagcgaacaactcagacagaaaccaagacagttatgttatcctactccaaagtttccgacaagctcctagttaatcagttgaccatttggaatgggaaactggaggacatgaaagaagcaacagatggagccaattccagcataccaacgatccaaggaactacaacaagcgagaacaactagcaggagacagtcttctgctttttttatagggagacaagatgacacgaattaaagcagtaaaacaaaaggccattttagatgttgctgagagtctgggttactccttcagacgtttatcaggacaaatttatgaacacccagaccatgattcctttcggatttttgcggataccaatactttcaaatggttttcaagagatatacaaggggatgtgatagactttgttcaattagtagcaggcgttactttcaaagaggctgtatcttatcttgaaactggggattttgaacaagccaagttggtagaagaaacttatcaaccgtttcaatattatttgcatgaagaaccctttcagcaagcacgtatttacttaaaagacatccgtggcctaagtgatcagactatcaatacctttggtagacaaggattgcttgctcaagctacttatcaatcggagcccgtattagtgttaaaaagctatgaccacaacgggaccttacaggccgcaagccttcaaggtctcgtcaaaaatgaagaaaaacacgatcgaggttatctcaaaaaaatcatgaaaggatctcatggctatgtcggtattagtttcgatattgggaatcctaagcgactcattttttgtgaatcagttatcgatatgatgagttattatcagctttacaaaaagcaattatccgatgttcgcctgatttcaatggaaggcttaaaactttcagtgattgcttatcagaccttgcgtcttgcagcagaggaacaggggaaattggcatttctagatacagtaaaaccaagcaggcttagccattatcttcaggcaatacaagagacaacaaccttttttcaaactcattcaaacgtcataacaatggctgttgataacgatgaggcaggaagagaattttgtcagaaactgtcagataaaggacttccaatcaccaaagatttaccaccattgcaaagacttgaaacaaagtcagattggaatgatattgtgaaacagcagagtgaactatctttaagtgattttatccaaacagcccaagcacaagtcaataagaatcatcctccacctaaatggaaacatgcattggaattgtgataacaaaatcaagtccgctatcataatctagaaagggacaaggaggacaccctatgagtgtgattgaacgtctggctgaaaaagtagctaggcaagaagaaaaggtctcacgtgagacagagaaattggaacactatcgtgaccaactacaaacagctatgtacagtacctttatcaaacggcaacaatctagtcagttgtcatttcatgaagcactagagcaagcctttggtaaagaaaccacactacactcaaattacagaaatgaggatacagaatgagtaaaacatggaattttgatcagccactagacgatgtgaaatcaacatcgtcccatgaagaacgagctaaaatcgcagcactcttccataaacaggatgaaaaaccaattgaagaagtagactatgtggctgcttttgaacaacaacaaaaggagtcaaaatataaagatgaccaaacgctcgcatcaaccgttaaacaaagtcagccgaagaaggtaaatatcacaagtgactataaacaacacttggctgataccattgcacaaaataacaaggatatttcggcctgtcaaaagcaaattgaagaacttcatcaattgattgatgaaaagaaaatccaaaataaaaagttgcaggctatttcagtagccattgatgatttataagtcaggtagtcctatgcgggctacctttttacaattgaaggagaagataatgaaattttttcaaaagaaaaaacagaaccaggatcaatttaaacgactgattcatcgactatctgagatgtcagatactgaattaaccaaagtagaacaactcctagatgtggtttttgatacaaattttaagcctgataggaacgttgaattatctcaaagcgttataaacgatgaggaacaaagtcttgataagtcgatccaagaagcgaaaaataaacttaacatggaacaattcgaaaaaaacattgagagatttagacaaggtaggcgagagagcaataataacaaataacagaccaattattttggcctgttttttgaaatatgtgtcatcgttgaatcgtaacagtatagcctaaccagattattatctcgtgaaggttcaacattgaacataaaataatggtcctgataatctttagcgttttctttgttcaatttgaaataggatttttgagatttggccatggcaagcataatatcatccgttaaaaatgttagtggtgtatctagagcagaatagcgatagaaatccgcttcaaattttcggtaactgtcactaaaatagtccatctggagttggttcttattaaaatcaagctgattcatactctacctccaagtctattgcaagaatatcagatatttgaatactgatgtagccttcttttgtttcaaatgaaatcaattgaaaagtcaagttctttacttttcctacataagtcctaccaggaactgtcagaataccagttaattggtggctatatagttgattgagtagcagtagcttatctgccaaacttaactcacttgaataatcaatgcgattacgttcttgttctaagcctgatgtatgttctgataagaaaaatcccatccatttggccatttttcggtcttgatattctctagcaaccttaaatggcagataacttctatcaatcattttaatccctccaatcctccagcggaatgtccgccgactaatctactgcgagcaattgcccttgaattttctaataaagaactagctttctgtacagcaagaaatccaaatcgatcacgaatggaatcaatggttgtctccaatttttcctctttttcgctttcttcaaaatcatcaaaaagagaaatcacagcaaagttttcatccaccaatccatcgtaccttacagcaatgcttctaactgcccctccatcgtatttagcacgaaagagagaaacaacttcatcttgaaaaacaagcgtacgattatttgggttaatttttctctgaacattgattgatttcttgttttcgaagtttgaatagcctacatttatggcaactacggttgcttttttgtgcattctgcgtagccgaatcgcaacttgctctgccatttcacgtaggacaagctctatatcgctttgacgtgtatagtctttgtgaagtacttgtgaattgccaatcccaacttcttttggccgatagggttcatggacattgctctcatcaattccattggcatggaaccagtgttgcacgccaatcacaccaaattcttttttcaagatagtagggtcacagttggccaactctttgatgctgtagattcccaatttgtttagtcgtttttctgttcgtgaaccaattccccaaaagtcagtcattttcggaatgttccagaccttcgtttcaacgtcttcataggaccaatttgcacgcatggtagcagtactttttgcttcattgtcaagtgccagcttggctagaagtggattagcattactcatacctactgtagaatatactccagtcttttcccaaatatcgtgctgtatttttgctgaaaccaaatctaatttatatttacgactaagagttttatctccaacaaaataatttagtgatgaagttaagtcaataaatccctcgtcaattgaataagggagaatatctgttgggtctgcataattttgaaatactttttggatttctagatttttttggatgtacaagtccattcttggtggcacgataaaggtacgcttagcccagttttcaatataagagacgaacttggcatctgttggtagtccagaaatgcttgcacggtaatagttaaattttcgtgtgtggacatcaaaggggaggtcataagctctaccgacgttccctttaccaaatatcttcttaaacattggagaagaggctaaaattagtccagtagaattatctgccctactcataacacaaagagatgtatggagtggatgaagccctctctccacgcattcaatggacgcatagaaggatttcatatcaacaaaagcaatatcgctacgaggttcttttgagtagtcgacatagcccatagtattcacctagatttcaattttgctaactcatctaccaattctgttagatggtctgttacatcatactccttttggtcgagtaatataataatgcgatttgatttaatgtaaatcatgtcgtcaaactctttagacatttctaacctccaatcacaggcatgaagtggccaacaactttgccaacaattctgatttcatcttcaaatgggataaatctttcagcaacatctgggttaattgacaccattcggaatccatcttcttcacgatagagtttcttgatatagagcgatccattccaattcaaggcatatacagctccatcgtaatcaaaaccagttgatctgattaaagcgacttcaccgtctttataaacaggttccatagaattaccagaaatccatgtcgctatatcgaatcctgtatattcatcttccgaatagacagtctcagtttcaaattcatcgtatagaccttcaccaggaccagcaaatagttggatctcagataggacttccacagcaaacagcggaataattttattgtgaatcccttgttcttgaagtaattcttcagcatacttctctactttttcctggttctgtaaagaaagctgaagataagtattcactattttatattctgactcaaaatatgtttcaggaacatctaataggatagccagctgtttgagattgctttggtttggtttggtcttttcattttcccagttgaaataagaagatcggtttatatgaagtttatctgctagttcagattgagaatagccgagtgttattcgtctttcttttaatcgtttaccagaaaacatattacctcctgaaaacttttgttgttttataaactaacaaaattatatcataaaagatttaagatgcaagaggaaagtaatgtaaaacatatcatgaatttattatttaaaaataatagaatgatttatgtgatataatttcaataaataacttttcaaactaaatatgcgagggtcaggtagtctatatgatatcaagaattataatacaaaacttttaacgttttcagaaagttgattttacttgtaattctgaagttaatatttttgttggggagaacggttctgggaaaaaccaaaagtaaattttatggtgcgtgtacacgtacgaggggaaacctatattttgtaaatcaatccgatttaggaaaatataagaagatgatgtaaaggaaatatcatattaggagagagtatgagaatagctaaaaatttatttataaaaagaccaatgaagtggcagtatattttatcaattgttatggagattccagtttttatatggtttatcagaaatattccacaagtcttgtggcagtggggggtaatgataggttatataataatttcttttatatactatataataaatagtggtgatatgatatattactcgttagtggcaacagttttgactggtgcctttttcttgaacggctatattttagtcttgaacggtaatgtttttcccgtttaggaaagttaaatgactgttcaggaaatggtgattatttttgtaagaagagtgctatactaaaggtgtcaagttgcaacggacaaatcaataaaaatagaaaacataaggagatattcatcatgaatacacaaacaatttcacaatttgaacttttggacactgaactgcttgcgactgttgaaggtggagcctcaggtaaatgtattgcaggtgttgtggtaggtgctctgttaggctctgtcggaggaccatggggttcagcagcaggaggtgctgttggagctggtttcttctgttagtaggtctctttatgaagaaatcaatatttcagtatagagtaactttacaatcattatcaccaactgctcgaatgatactgtcagttctatcatctttgttgatatatcagatgatttcaggtggtatttctgatatgttagcatttactatcagatgtgcattactcatcgggactttgggaataattgttagcggtaaaggctatttattccaaaagaaataggttgcaatagattctttcaggacaccagcattattagatttgataaaaattgcatcagaagaggatgataaataatttttcagagagcgtcagctctcttttttcttactctcattttcaattctgtgataccttttccaaatcacctctattatcctaatatcattcctaagaaaatcaatccttgatttttcactgggggtttgggggcgaagccaccaagttatcttatcgttagctgtcaaaactggaaggttttaatcagctgacgatatgatttttgggatattgtggacacaatatctgagctcgcaaagaccgaacaagaagagagtgaggtctttaggaagcgtactgacaatgtgaggcagcctgacactgtcagataagtataatgttgaaaggatagtaggatgggacaagaaattaagttaatccgtaagcaatttaggatcacgagacaagaagaaaaacagataaaagaaatgatgagggaacaaaaactggatagtttctcagaatttcttcgtcaaaatttgttgaaaaagaattatcaggatagaatttttgaaagttggttttccctttggcaatctcaaaagtttgaacaaattagtcgagatgtgcatgaagttctagttgtcgcaagagaaaatcaccaagtgactcaagaacacgtttcaatcttattgacctgcgttcaagaattgattgcggaagtcaatcaagtacagctactcagtcgtgggtttcgtgaaaaatacatgagataggaggctactatggtttatcgttatcgtaccaatctcaaaaaagtatttctaacagattcagagttacatcaattgaatgagcgaatcgacaagagtcactgtcaaaatttttcagtctatgccagaaaagtgttgctgaatcccaatatgtcatttgtcacaattaacacggatacttatgaccagttagtatttgaattgagacggattggaaataacattaatcaaattgcgcgtgccatcaatcaaagccatttgatttctcaggaacagttacaagaattgagtaagggagttagtgagttaattactggcgtagagaaagaatttcaagtggaagtgaaaagactgagggagtttcatggtagtcactaaacactttgcgacgcacggaaaaaaatatcgtaggcgtttgattaagtatatcctcaatcccgataaaacggacaatttgaaattggtatctgattttggcatgagcaattatttagacttccctagctatgaagaaatggtagaaatgtacaatgtcaactttaccaataacgacaagttgtacgaatctagaaatgaccgacaagaaaaacaccagcaaaatattcattcccatcacctcattcaatcattttctcctgaagataatctgacacctgaagaaattaaccgcattggttatgataccatgatggaattaacaggaggtcgctttaagtttatcgtagcgactcatacagacaaagatcatgttcataatcacatcctaatcaacgccattgacagtaattcagataaaaagttgatatggaattatgccttggaacgaaaccttcgtatgatttcagaccgcatttctaagattgctggagcgaaaattattgaaaaacgtttctcctaccgtgactatcaaaaatataggcagtctagtcataaatttgaattgaagcaacgcctttatttcttgatgcagcactcaaagtcctttgatgattttttagaaaaagcggtgcagttacatgttcatattgattttagtcagaagcatagtcgattcatgatgagggatagagcaatgacaaaaccaattcgaggacgccaactcagcaaacgagatttgtatgatgaagaattttttcgtacacattttgccaagcatgagattgaaagtcgtttagaatttttgttgaaccgtgtcaattttttagaagagttactaacaaaagcaaaagaattgaatctaaccattgacttaaaacaaaaaaatgtaatctttatacttgaagaaaatggaaagcaattcagtctgagtcataaaaaaataagtgataagaaattatatgatgtcaatttttttcaagattattttaaaaataaggaagtcggtgattcagaaggcttagagaatttacaggagcagtaccatgcttttcaagaagaacgtgataaggagaaggtagccactgaagaaattgaggaagcctttgaggaatttaagaagaagcgagatgccgttcacgaatttgaagtggaacttgcaggacaccaaatagagaagttagttgatgagggcgtttatatcaaggtgtcttttggtgtaaagcagagcggttttattttcattcctaactatcaattagatataattgaagaagacaatcagaaaaaatataaagtttatattcgtgagacaacttcatactttgtctataacaaagaacattcggataagaatcagtatataaaaggacgaaccttgattagacagctaaccaacgatagtcgagcaataccatacagacgaccgactgttgaaagacttcaagaaaagattactgagattaacctcttgattgagttaacagagacagacaaaagataccaatacgttaaagacgaactggtcgcagaaatagcagagctagatgtcaaactaaatcaaaccaatgaaaaaatcgccatcttgaacaagatggcggaagtgcttatcaacctaaagagtgatgatccgaatagtcgaaaactagcaaggtatgacttttcaaaactaaatttgacagaatcaattacactagaacaagtgactgaagaaatacgagtattgcaagaggacctaggacattatcttgatgagtatgagggactagctaggaagttggaaacatttgtcaagattcttaatactaataaacagacagaacacgaatttcatggagatattgccctagaataaataaaaccagtctattgactggtcaaaaaatagtatattgaaattaaagtaatcggtagattagttcttttaagtctttagcagtttgaacttcatgaattttagtatcactaggtagtttgcgtttcctgtgattaaaccaaatggatttccaaccagcatttaagcttccttcaatatcattttcaaagttatcaccaatataaagtgtttggttggggagaaaattgaaattcttagaagcgagattaaaaatttcaatttgaggtttttggaaaccagttgcttggctaatgataattttctctttatcaaagtattttagaacgtctaattgtgataatttttttaattgatgtttaactggaccattcgttatgattccaatgggaatcctttttgccgaacagtattcaagaatctcttttaattcaggaaataaggtaattgaactgagttctttttcgtatgttttttggaaagagagtgctaaatcatcagaaaaactaaaagatccaaattcacttattatctgtttacaacgaaaaatacgtagttcttcaattgaaatttgcttattagtgtattttggaaaagcaatatcagaccaatacctgaatcgtttatagataagttcaatttcagaaatatcaagttcaggaaaacattgtatgatactatttttgaatggtaaaagatggtcatataaggtatcatcaagatcaaaaacgatatttttataagtcataagtgagtttaatctgcttgaataatagttgttagtcggccaaattcatttagttggtcttgggatatttgattatcagtaatgatggtatcaatttgttctagggtatagaaattaaagaaatcataacgattgaatttggtactatcaaccaacaagattttttcaacagcattgtctagtgctaattgttgaatttctccttcaacgtcgctgtaagttgcgatagcgttatctgatacagcgttagcacttacaaatgctttggaaaagcgtaaggtttttaggttagttgtagccattgaaccaacgaacgcccctgtaatttctctgtactctccgccaatcaataataagtcaacagtcccactcttattcagtataaggaaaacaggaagactgtttgtaattacacgaatattacgagtttttaactcaactgctagatgttctaacgttgttccaggaccaataaaaacagtttcaccatctttgatgatcgaattggctttttgtgcaataagtttcttctctttagtttgaagtacctttttttcaatatgagttttttcgtgcggttcttcatctttatagagtcgttgtgctcctccatgtatacgagtcaggaatcctgcttcagcaagtgagtctaaatctcttctagcagtcatatcagagatatttagctctttcatcatatctttgacagtaataacaccttcaatgtttaacatatctaagatacgttcgtgcctttctttctttatcataactatgtttcctttctgtacttacaaaataactatctgttagtattttatcataaaaaaatataaaaacaaacaaaacagaacataataaacataaaaatagttgacaatataaaaaaacatgattatattatatgtttgtaaacgtcattgaaagtgtaacagaggaggattaagtcatgacgaaaaaaataataggcgttgatttaggtggaacatcagtaaaattagccattttagatgttttaggaaatatagaagctcaatggtcaatcccaacagatataagtgataatggcaaaaatattgtatctgacattatcagttccattcaagaatatctattagaaaatagcatatctttaggcgatattaagggcataggcatgggaagtcctggcaagattgattttgaaaaaggaacagtaacaggagcttataacttagggtggtcgaaagaacaaaatatcaaagaacaatttgaagaagcatttggtcgtcctttttatatagataatgatgctaatgttgcggcgcttggtgaacgatggaagggggctggagataacgcacctgatgttatttttgtaacacttggaacaggtgtaggtggaggaattattgctcaaggccaattacttcatggtgttaatggaagtgctggtgagattggtcatatggttgttgatgaagatggatttccatgtacttgtgggaatattggatgtttggagactgttgctagcgccacagggattgtcaatattgcaaaaagctttgctaatcaatttgatgaaccaagtgaattaagaaggttaattttagaacatcaagtaactgcaaaggatgtttttgattacgctaagaaaaacgattctcttggccaaaaaattgtatggcaatttgccaattacttaggtaaatcattgagtcaattggctaatgcacttaatcccaattatattgttattggtggtggtgtttctgctgcaggggattttcttttagataaagtaaaagaagagtttgatagatttgcttttccaacagttaggaattctactaaactagctttagctactttagggaatgatgctggagtgattggagctgcaagcctagttttataatagttataccaacaaatattaagtttgttggtgtttttattttttaaaaacaaacaaatcaaacacaaatagtttaaaacacaaaaaaaaaaacataaaactgttgacttttgtttttaatggtggtattataatggtgtagaaataatgaaagcgttatttcaaacagttttgcaaaaatttatcgtcgatgtagctacattcaattattttctaatgtaacaggagaaagaaaatggcagtaattattggtgctgataaagcaggtacagaacttaaagagacagttaaatcatacttgattgaacttggtaaagaagttgttgatgtgagtaaagatggtcaagacttcgtagatgtaactttagcagttgctaaagaagtgacctctaacgattcaaacttgggaatcgtagttgatgcgtatggtgtaggacctttcatgacagcaactaaaatcaaagggatgattgctgcggaagtttcagatgagcgttctgcttatatgacacgtggtcacaataactcacgtatcattaccattggttctgagattgtaggacctggtgttgccaaaaatatcgctaaaggatttgttgaaggtgaatatgatggaggtcgccaccaaattcgtgttgatatgttgaataaaatgtgctaaaaattcaaaagttaaaattagaggagaaaacaaatgaaaattgcagtaggctgtgaccatattgttacaaacgataaaattgcggtagtagactatttgaaaactcaaggttatgaagtgattgactgtggtacttacgataacattcgtacgcattacccaatctttggtaaaaaagtaggtgaagcagttgcgagtggtgaagcagaccttggtgtatgtatctgtggtacaggcgtcggcattaacaatgctgtcaataaagttcctggtattcgctcagctcttgttcgtgatatgacatcagctatctatgctaaagaagaattgaacgctaacgtcattggttttggtggtaaaatcactggtggtttattgatgacagatattattgaagcgtttattcatgcagaatataaaccaacagaagaaaacaaaaaactgattgaaaaaattcaacatgttgaaactctcaatcaaggacaagctgatccacacttctttgatgaattcctagaaaaatgggatcgtggtgaatatcacgactaagaggtaaggttatgattctgacaataacaatgaatccgtcagttgacatttcttatccgcttgaacaattcaaattagataccgtgaatcgtgttgctaaaacgcacaaaacacctggtggaaagggcttaaatgttactcgagttctttcccaactgggagatgatgtgattgcaagtggcttgttaggcggtaaaattggagagttcatagagagtgaactagataagtcaagtgtaaaacattcgttttataagatagccggggaaacaagaaactgtattgctattttacatgatggcaatcaaacagaaattcttgaacaaggtcctacgattagtgaagaagaagcaacagggttcttaaactattttgaaaaactggttccagatttaggaattgtagctatctcaggtagtctcccaaaaggtcttgatacaaacttttattctcgtatggtgggaatttgtaataaatataatatcccagttgtattagattgttcaggagaggcccttctaaatgtacttgatggacaagaaaaaccaacagttattaaaccaaatactgaggaactttctcaactagtaggaacggaagtgactgatgatattgatagtttgaaatcagttcttcacaattctcttttcgatgggattgaatgggtgattgtttcacttggttcaaaaggagcctttgcaaaacatcatgatgttttctataaggtatctatccctaaaattgaagtggtcaatcctgttggctcaggagactcaacggtagctggtattacatctgctttagttcataacgatagtgatgagaatttattgaaaaaagcaaatgtacttggtatgttgaatgctcaagaagcgctaacaggacatgtcaatcttaacaattacgataatttatttaatcaaatagaagtaacagaggtataataatggtattaacagcacaaaaacgttcattgatggaaaaagtcagcgataaaaatggcgttatctcagctttggcttttgaccaacgtggggcactcaaaaaaatgatggcgaaacatcaaactgaagaaccaacggttgaacagatcgaaacattgaaaacaattgtttcagaagaattgacaaagtatgcgtcctctattcttcttgatccagagtacggtttaccagcgtccaaagctcgtgcagacgaagcaggactattacttgcttatgaaaaaacaggatacgatgcaagcacaacgagtcgtttaccagattgtttggatgattggtcagtcaaacgccttaaagaacagggtgccgatacactgaaatttttgctatactatgatgtagatggtgatgagcaagtaaaccgtcagaaacaagcatacattgaacgtattggttctgaatgtaaggcggaagatattccgttcttccttgaaattctgtcttatgacgaaggtattgcagacaacacaggtgttgagttcgccaaagtaaaacctcgtaaagtgaatgaagcgatgaaagtcttctcagatgagcgtttcggtattgatgttcttaaggttgaagttccagtcaatatgaatttcgttgaaggttttggtgatggtgaagttgtctacactaaggaagaagcagcacaacacttccgtgaccaggaagcttcaacacacctaccttatatctatttaagtgcgggtgtttctgctaaattattccaagataccttagtatttgcggcagaatcaggtgccaaattcaatggtgttctttgtggacgtgcaacatgggctggctcagttcaagtctttattgaacaaggtgaggaagcagctcgtgaatggttacgtacaactggattccaaaatattgatgaattgaacaaggttttggaaaaaactgctagtccatggactgaaaaagtataatcataaaaattttcggaggaaataatcatgaatagagaagaaatcactcttttaggatttgaaattgttgcttatgctggagatgcacgttctaaatttttagaagcattgaaggctgcccaagaaggtgactatgccaaagctgaagaattgattgcagctggtggtgagtgcttaaatgatgcacacaatgctcagacaagtcttctacaaaaagaagcagctggtgaggatcttgcctttagtgttaccttaatgcatggtcaagatcacttgatgactacaatcttacttcaagacctaatgaaacatatgattgagttgtataagagaggagcaaaataatgaaagggttgattgctcaaattgagaaagggaaacctttctttgagaagatttctcggaatatttacctccgtgctattagtgatggctttatcgctggcatgccggtcattcttttctcaagtattttcatcttaattgcttatgttcctaatgcttggggattcaaatggagcactgatattgaaacacttttgatgactccatacaattactcaatgggaattcttggattgtttgttgctggtacaactgcaaaagcattaaccgattcaatgaaccgctcattgcctagcacaaatcaaattaacttcatttctacaatgcttgcagcaattgttggcttcctgttgatggctgctaatccagcaaaagatggtggtttcttaactggatttatgggtactaaaggtttgcttacagccttcattgcagcctttattacggttaatgtttacaaggtttgtgtgaaaaacaatgtcactattcgcatgcctgatgaagttccaccgaatatttcacaagtatttaaagacttgattccatttactgcgtcagtcgtattgctttacgctattgaacttcttgtacataatgcactaggtgtaaatgttgcggaatcaattggtacactattagctccattgttccaagcagcagatggttatgttggtattaccattatctttggtgcctttgccttcttctggtttgttggtattcacggaccttcaattgtagaaccggctattgcagcaattacctatgcaaatgctgaagctaacttacaattgcttcaagcaggggaacatgctgataagattttgacatcaggtactcaaatgttcatcgttacgatgggtggtactggtgcaacattggttgttccgttcatgtttatgtggttgacgaaatcaaaacgtaataaagcgattggacgtgcgtccgttgttcctactttctttggagttaacgaaccaattttgttcggtgctccactggtattgaacccaattttcttcattccatttatcttaaccccaattgttaacgtttggatttttaaattctttatcgagacattgggaatgaatagttttactgcaaatcttccttgggtaaccccagctcccctaggacttgttctaggtactaacttccaagtactatcattcatcttagctgctgttttgatagttgtcgatgttgccatttattatccatttttgaaagtttatgatgaacaaatgctggaagaagaacgcactggtaaatcttcagatgagttgaaagaaaaagttgcagcaaacttcaatacagctaaagctgatgccattcttgaaaaagcaggtgcagtagaatcaaaagaaattacagagcaaacgaatgttcttgttctttgtgcaggtggtggtacaagtggattgttggctaatgctttgacaaaagctgctaaagaatatggtgtaccagtaactgcagcagcaggaagttatggtgctcaccgtgaaatcttgccacaatatcaacttgttatcttagctcctcaagttgcttcaaactatgaagatatgaaagcagagactgacaagcttggcattaagttggctaaaacagaaggtgcacaatacatcaaattgactcgtgatggacaaggcgctttggactttgttaaacaacaaatgttaaattaaaatagacaacattagggaaggttgggggaactcaacttccctttttagatgaagaggaaaaacaaatgtcaaaaacattacctaaagattttattttcggtggtgcaacagcagcatatcaagctgaaggtgctactaaaacagacggtaaaggtccggttgcttgggacaaatacctagaagataattactggtatacggctgagccagcaagtgatttctataatcgctatcctgttgacttgaagttggctgaagaatttggtgttaatggaatccgtatttcaatcgcttggtcccgtattttcccaactgggtttggaaaagtaaatgaaaaaggtgttgaattctatcacaatctttttgctgagtgtcataagcgtggcgttgagccatttgtaactcttcaccactttgatactcctgaagctttacattcaaatggcgatttcttaaaccgtgaaaatattgaccattttgttaactatgcagaattctgttttaaagaatttacagaagttaattattggacaacctttaatgaaattggaccaattggtgatggacaatatcttgttggtaaattcccaccaggtatcaaatacgatcttgctaaagtcttccaatcacatcataacatgatggtttctcatgctcgtgctgtgaaactgtttaaagatggtggatataagggtgaaattggagtagtacatgctctaccaacaaaatatccatttgataaaaacaatcctgatgatgtcagagcagcagaacttgaagatattatccataataaattcattcttgatgcaacttatctaggtgggtactcagagaaaacgatggaaggtgtcaatcatatcctgtcattaaatggtggtgagcttgatcttcgtgatgaagattttcaagcgctagaagcagctaaagatttgaacgatttccttggtattaactattacatgagtgattggatgcaagcctttgatgggccaacagaaattattcataatggtaaaggtgagaaaggtagctctaaatatcaaattaaaggtgttggacgccgtgaagccccagttgatgtacctaagacggattgggactggattatttatccacaaggtctatatgaccaaatcatgcgtgtaaaacgagactacccaaattataagaaaatttatatcactgaaaatggtttgggttataaagatgaatttgtagacaatactgtctatgatgatggtcgtattgattacgtgaagaaacacttagaagtcatttcagatgcgattgaagatggagccaatgttaaaggatactttatttggtccttgatggatgttttctcatggtcaaatggttatgaaaaacgctatggtctcttctatgtagattttgagacacaggaacgttatccgaaaaaatcagcctactggtataaacaagtagcagaaactcaggttattgaatagataatattcttcttaaaaatttctaacgcaagataagagtgtgggtgttatactgacgctcttgttttgtataacggagggaaaaatatggttattgaattaaaaaatgaacagttaacagtacagttttcggagtttggtggtgctttatcttctattaaagataaagatggagttgaatacctttggcaaggtaatccagaatattggagtggacaagcgccagttttatttccgatttgtggaagtttgaggaatgattgggcaatatacagaccagcagaaagacctcattttactggaattattccacgacatggattagttagaaaggaaaattttgattattgtaagatagatgacagcacagtgtgctttagttttaaggctaatgaaaaaacacttaaagaatatccttatcattttgtgttgaatattatatataaattacatggttcaacgataacaacggaatatcaggtgacaagcagtgaaattgaacgttctattccttactttattggaggtcacccaggatttaattgccctttagaagatgacgagaaatacgaagattattatttagaattttctgaatatgaaacttgtagcattccaaagagtttcccagatactggattacttgatttacaagatagaacaccttttcttgaaaatcaaaataaattagatttggattattctttgttttcacacgatgctattaccctagatcaactaaagtcacgtagtgtcagtttgaagtctaaaaaaagtaataagggaattaaggtggattttaaagattttccacatttaattatttggtccaccactaatcaaagtccatttatagccttagagccatggagtggattatcaacatcattagaggaatcagatatattggaagagaagcagggggttacatttgtagaaccaagtcaaactagtattaaatcatttgatattactattttgtaaattaaagtaatctgaacggaatctaaagatagggactttagaaatttacaaaaatccaatataaatttgtataatctaatgtaaggtggtctgaggtagtagtcaatctagaatatattcaaaatagtattgaaatatttacaaaaataattgttggttttaactaaacaataattactgtcatattatgacaatttcccagcttttttctgaaagtgacatatacttttcttaggagaaagctagatgtaccaacggataagagatttgagggaagatcacgatctcactcaaaagtttgttgcaaatttactttccttttctcatacaaattatgcaaaaattgagagaggagagattgccttaacggcagatgttcttgtgcagctttctaaactctataacgttagtacagattacctattagggttaacagattgtcctgataggataaaacataaaatagtctctccttgatttgttcattgacaattgaataaaccgaggtgggactttcttatttgtcgagcaatttagtgagatacgccgtgataggagcgaaaattattagctataaaatagagtggttctctatctgccatgaccacaaataaggacaatgatacttctgaacgttcaggctgccagcgtaaaaggacagcgggtgagacgcccatgagtgatttaaccaatcatacccaccgaagtacaattttgaaataaaaggaattaaaaatatggaaaaaacaagtacaggtgctgagtcaccacagattatgattgaaggttataaagttattgtgaaggttacagataaaccattaagtcttacagatatactagatgatttattgggccgacagctagaaaaaatttaagattttagcggacaagttcacataaattatgtaaaataaaagtgtagaacctcaatccttaatcggtaagcacctaaaaactgattaaggagaatattatggcacaagcatgtatttatttacggttatcacgtgatgatggggataatgttgaaagtaactcaattatcaatcagcgctctctgttacgtgactatgctagaaatcatgacattactattttagaagaatttgtggacgatggtatcagtggcttaacctttaatcgccctgatttcaatcgtatgatggagaatattaataataaaacgattgataccatcattgttaaagacttatctcgatttggaagagactatattgaaacgggaaaatatatccaaaggatatttccagctatgggtgtccggtttatctctgttaatgatcactatgatagtttgactgcagatgctaatgaaacccatttagtaatgcctattaagagtcttatcaatgatagctattgtagagatatttccacaaaagttcgtagtacacacaaagcaaaacggctaaaaggtgagtttataggagcatttgctccgtatggttatcaaaaagatcctagacaaaaaaatcatttggttgttgatgagtctatccgttcaatcattgaaaaaatatttacattgaagctggaaggctactcatcaaatcagattgctatatatcttaatcaatgtggtatagaaacaccattacaacataaaaaacgtaaccaagaaaaacttagaggattttgtggtcacactaataagtggggcaccaagatggttaatcgtattttaacgaatagagtgtatactggagccttggaacaaggtaaacggacgaaacttaattataaggctcaacacactattaaagttaatcaagaagattggatttgtgtggaagcgactcatgaaggtattatttctgaaagtacctttaagattgctaacagtcttttactgagagatgttaagaatagtaataatcaacctaatgaatttgctggtttattattttgtaatgactgtcatgctcaactcttacagcgtaaaatacgctataagaataaagaaacaatccagtttatttgtagtacctataataaagggagaggctgtagtcgccatgcgattaaatatgaagagttaattagcattgtatctgagttaatcgaaaatcatcttgattggaagtctcatctgataaagaaaattccagagtacctttcacaagaacagttattagaaattgactttacaaatttggtatctgaccgtagaaaatatgaacagttgcttcaatctttatatatggatttagatgatggactgataaatgaagcagaatatcaggagtttcaacgaagctatcgccaaaagctaaaagatattgaacagacaattgttaataagaaaaagcttgcacaagaattagttaataaactacaaaataagaaaacttggttgaagaaattgacttgccaaaaagaagaatcatcgttgaaccgtctgactcttgtaaccttgctggatcgtattaacatttctgaaaaccaagaaatatcacttgtctttcatgacttgaatgagattgctattttacaggaattatcactttcagaagtgggggtgatttaatggcacgtaccaaaaatcgctaccgtaaatcagaggtgacagataagacatcagaactaaaacggtactctgctggtatttatattcgcttatcaaaagaaagaacagaggcctgtaggaataaatctcagtcactagaaaatcaagaaaaacttgctagaacctttgcaaatcaacatggtctaacagtcgttaagtgttatactgattatgaatattcaggaacaaactttatgagaccagcctttcaagaaatgatggatgacattaaaaaaggtgttatcaattgtatcttgatacgtgatttatcacgtttagggagagattacatagagatgggaaggcttatagataaggtttttccatttctaggtgtgagatttatttctatcaacgataacttggatactctaagtggactaaaagaaaagaaatcttttgaagttgaaatcaagaatttggttaatgatatgtattcgaaagatatttcaaaaaaagtaactgctagtcatattcaaaaagcaagtgaaggatattttatcagtggctttgctccttatggttataagttagataaacaaaaactaggcaataaattaaagattgacttgactgttaaaccaattttagataaggtatttgagttatttttgactggttattcttcctataaagtaagtgattggcttaatgagaataatatagctacaccaacttcatatcgtcagacaggagaattgtatagaagaattgatgatacaaagctatggtctaatactaaccttcggcgtatgattagaaatcaagtttatacaggggatcttgtgcagcgtaaatctaacaaacagttgtcacccgatgattatatccattttaataatgcccatgaatcctatattagccgcaaagattatgaaactatattagaattgattgcaaataggaaaataactaaaaaatatgattattctaggacacctaatcgttatagaggcttgctttatttgaaggggagttacaggcaaatgtctagagaatatcagaaatcaaaaagcaagaaaaattgtgagggacatttttattatagagattatattcttaatagtaacgctaatagaaaatcggtgtgtattcgtgagaatgttctagataggataattatcactatcatccaagctgagatggcaaaaattggaaaagttgatgagttgttatcttcactagaaaatatgtatgaagcctacattcaactcttgcagagtaagattgttaagcataaacaacacattgttaggttacgaatggaaatcagcgatttatatgcctcttatagtcttttaagagatagtcgagatgactatatcagccagaaattagaaaaaaatagaaagattgaaacacttatacaagaaattgatcagtatgaagatagactaaaagcagtagatgaaaagtataatagacaagttgcttggctaaatacactatctaaaaatcatcaatcacctgttttatctgccgatttgctaaatgctttaatagagcgtattgaaatagacgagaatagacagatatcggtaacttttctttgccaaatagggagtgatggtaatgcctaaaattgcgttatatctccgcctttctgttgatgaagcaacagctgatgaaagtaattcgattactaatcaaaggattttactgaatcagtatcttgaccgaacaccagaatttcatccatttaaacgtattgaatttattgatgatggtttctcaggaaaaaatcctaatagaccagcttttaacagactaatgtcggatgttagagtaggaaaaattcgatatattattgtaaaggatttttcacgctttatgcgtgattatttagaatttgggaattatattgaaaatattttcccttttctaggagttcgttttatagctgtaaatgatcaatttgatagtttcacttctgaaaacaatggtgttgaaattgatgtcccttttagaaacttgttaaatgatttctatgctagggatgtctcggaaaaagttaaaagtgccatgaatacaatgaagcgttcaggtaagaatatgagctggctacctccatttggctatctaaaggatccgaatgatcgttttaaaatcattattgatgaaagtgtagcaccagtggtaaaacgaatttttcaactgtgtattgaaggtgtaggtctatctcgaattgcgattattcttaatgatgagaatacgattacaccagcagagcgaaaaagacagatcagtcaggcggattatcaatatcaaatagtagtgactgagaagcagaagaggaatatttggactcgttccactgtttctcgaatccttaaaaatgaagcttataaaggaacctatctatttaatgccaagacaatattcaatggtaaacaagttaaacgcccaaaggaggagtgggagcgaattgagaacaaccatgaatcaattgtaacaagtgaaatctttgaacaagctcaaaaggctttaaaatcgcgtaacaataggcattcttatcaacaatcaacaaaaaaatatgatgtcatattaacaggttttatgatttgtgagcattgtggtcataaattgacagcatacacttataaaaagaagactcatcattatttctattgtagatattgtaaagtccagggaattagtttaaaaggttgtcggtctgatagagtggagcagaagattttagaatatttaaaatctaagaaagaagacgttccgtctcaaaaatcgaataagtctcttgtttacttgatgtcacaattaaaagctcagaagttttcatattaccaagattacaaggatgaaaaaattaaccgagaaacctatatatattataagcaagaaatagataagaagattgatgatattgaagaagaattaaacaaattgaataattctcaatgtatgattgacagttcgctatctaaagaaacacttcgagaatcagtgaaacaaattatagttaaccatgctggtggctatcgaattgactataagaatatttgaagagactttatcatgaagtctctttttaaaaaaataaaaaatattgttaagaaattctgtcattaacttgacacaagagggcaatgtagagtccaccatcaagattgctaagaaaggcctgccaatcgtgtatgcagtcattggtgcaggtgcccatcgctttaaacctttagtcgatgcttatcgcaaggttgctcgcaactcaggtcatgatccaaagaaaacgaaagttgcagcccattcttggggttggattgcagacgaccatgacaaggctgtggaagaatactatcatccaactaaagtaattacggacaatattgccaaagaccgcccacattggagcgagatgaccaaggcgcaatatctctactctctgacagacgaaggagcaaccatcgtcggagatccaaaacgagttgctgaaaaaattatcaagactattgaaacacttgacttggaccgtttcttcctccatctcccaatcggctcaatgccacatgaagatgtcctccgtgctatcgaactctacggaaaagaagttgtgccaattgtccgagattattttgcaaaaaaagaagagaatcagtcccaggactgatgagataaaaaggatgggacgttataatagcctcacttctctaaagtggagtcaacatctcagcgcagtggttgattggaagatttgttcgtgttttacactccacatcttcctctacggctgaagcgaacggtgttcgctttatttccgacctccaacagtcactattctgactgttctgtagcgaactctgttcgctctatctccgacctccaaaggttccccaaacctttggagctgtgcgggggtgggagtgaaacagtctggggatagactgtttcagctcaacaactggaaatatgaacttgttgacgaactctctatgattatttgagttctttcccactcccaatcctaaatatttttcataatctcctgaaaaacctgaccatgtggttgggatttttgaatgcaaaaacactcttggaatttccaagagtgttttacgtaacggtgttaaacagtttgtaatttttatttcatcgtcgggagtgagaaggtctggtagaccttttcagccaatcgccaagaaactggagagcgatttgaacatcctagtgaaaacaaacctagcaagctactcttgcttacttcatagtagggaatagcaacacatcccgaatagtagttgtatctgtcaagagcatgcagaggcggtcgataccgattccaagtccacctgttggtggcataccgtattcgagggcttcgatgtagtcgtagtcaacgcctgtcgcttcgtcgtcaccgagttctttagccttggcttgggcttcaaagcgttccaattggtcgattgggtcgttcaattctgtaaaggcatttccgtattccttggtcatgatgaagagctcgaagcgatctgtgaagcgtgggtcttcatcgtttttcttagccagtggagatacggctactgggtgaccatagacaaaggttggttggataagagttgcttcaacgtattcttcaaagaagctgttgatgatttgaccaacttctgtatggtgtttttccacagggaccttgtgctcagctgcaagggcttttgcttcctcgaagctcatctcttgccagaagtccacgccagtttgttccttaatagcgtcaaccatgtggatacgcttgaatggctcgtggatagcaatttcagtgccctgataagtcaccggaccatcaccgacaacagccttggcagtgtgctggataataccttcggtcaagtccatgatgtcttggtagtctgcataagcttggtaaacctcaatggaagtgaactcagggttgtgggtcgcatccataccttcgttacggaagatgcggccgatttcataaacgcgttccataccgccgacaatcaggcgtttgaggtggagttctgtcgcgatacgaaggaccatgtcaatgttttgggcattgtggtgggtgatgaatggacgagctgcagcaccaccagcttcgttgtgaagaactggtgtttccacttccaagaaaccaagtccgtcaaggtaacggcggatttctgagataatttttgagcgggtcacaaagcgatcaaagctctcgcggttagtaatcaagtccaaataacgtttgcggtagcgggtctcgatgtctgtcaaaccgtggaatttttctggcaatgggcggagcgctttagacaagtgagtcaacttgcgagcatggatagacaactcaccaacgtttgtcttgaagacatctccctcgacaccgataaagtcacctaggtctgcttttttgaagatttcatagttttcttcgctaacatcatccttacgaacgtagatttgaatctggccttcgcggtcttgaatgtgagcaaaacctgccttacccttaccacgcttggtcataatacgacctgcaatgattgctgtttgccctaattcttccaagtcttcttttgatttgtcttcgtactgggccttcaattcagctgagttggcagaacgctcaaaacgttttccaaatgggtcaatgccttgttcagcaagagccgtcattttctcacgacggacaatctgttggtcatttaattcttcaaaatgttcagttgacataaaaattttattcctccaaagtctgttatttctattttatcatagaagagagaaaaaatcagtataaattgctaataggataggaaaaaacagcagaaaattctactgttttgctttatagctggtatcattccaagctaattctgtaaagttttcgaaatcgcttgtttctaaaatagtaaccgatgcattatccaaaccacctcggtgacgcagttgggctggtggaaaaccaagtaggcgatggatagaagcggttagaaaagcaccatggctgacgatgaggactgtttccatgtcttgccctttcagcgattggacaaagtccaccattcgttgagttacctggcgaacgctctcagcttcaaataagtcattgttaaaaagtgctagattatgtttgagtgcccaggcttgtttgggatagatggcacgaaaaattgccatcttgcttccttccagcgttccaaaattccattcacgtaattgttgcgtggttagaacggtttggcaatggtgattggctttggcaatttctacggcagtgctatgtgcgcgctgcaaatcactagaataaatagcatcaaaggggatttcagcaaggtatttgcctagtttttctaaatcctgataagattcaggcaagagagctgaatctccagaatagccttgaaagcgtccctccaaattccattcggtcttaccgtgacggacaaagtagattttcaagtctagtccctcccctcgatcaaatcggcaaagtcagcttttacaaaatcagctaatacctgactgtcaattcgaatcgaccgaccaatttctccagcagagacaatcaagtgaccgagttcaagggcagattgatcaatgtagattgggaaattatgcttctgacgaatgcctacgggattgttggcaccatggatgtagccagttgtcttttccaagtccttttgcggaatcatactcacttttttattgccagagatcttggctaattttttctcagacaggtgttctgtgattgggataatgccgataattggtccagttttatctccagttaatgccagtgttttgtaaatttcgtgttcttcaattcctggtggaagttgaccttcgaaggcatttaaaacaaggctatcatgattgatcttagccttgtccaatatttggtccaccaaggttttctttattttaaccttttttgccattatttatatttttcctcaagtttactcatccaaagccctaaccatgctcctagtataaataggacaatagcagcaatccatgtaacaaagttagcgccagcataggaaatagactctttattacttgcttgtggaatcaaaattaggagagtagaagatgaaacgataccaataataaagtgataaacacgtgaatggtatactttcagagcgtggtccattgcttttgaaaatgcaaccattgcaagaacgccaccgattgcgattggtaggaaggtaccgaatagatcaagtgatttgaaaccatttagcattggcgtgtagatacccaaaatcaatagtaagtttgaagggctgagtccaggaacaagtacccctaaagcaatcaaggcacctgccaatacaaaactagcaaaagtagctggaagtgtcccgacaagatcgctcaaattgtaaagtaggaggccagaaataatgaatgtcccaatcaaccaagccaaatcaatgctatctcgtttgctcttttgagttgattctttaagtaggctaggaatcgttcccacgattgctcccgcaaaggcccacaaaactgggacttggaaatgttgcaataaaaattctacagggaaagagaaaagtgcgattcccaaaattccaccaattcctacaggaacaaaataaagaaagttttccttgaaatcttttcgaatatttgctaaaaatccaattagtcgctcatagattccgaggatagcagcgagtacccccccagagacaccaggtaagataaagccgagtgcgataatcatacctttaataattcttgaaatccaagaagccataatttcctccaaaatgtattataacgttcctattatagcataaagcaagtaaaaataattaaaaagactgcctgttagataaaatccagcaggcagttttggttaaagattgtaaaaacctggtcttgctctatagagtaaaatgagcagaatagaggcaattgctgtggaaggaagaatatagctgatattgtaggtaaaggaatagaaccagacaggcataccatctggagcgtagtctgcgtagaaaataattcctgataagaaggtggctaacaatcggatgcttcctcctagaaaactagccagagtaatgatgagagtagcattttttagattgttttgtttggatagggtgggtgccactaaacctgctaaaccaattccggcgtaagaaaatgcgtagtcgagaaaaacttgaaaaacgtttaggaagtagccaccgtagaaaagttgaatggttcctacaataccaccagtaagaactcctacccctagtccgtggcgcagagcaagcagtaagattggaagcatgactaaagacacagatccaccttggggcattgtaaagagcgggattttgtcaaagacgagggcaatggcagaaaagatagcaacttcagctaggatgggtaattttgatgtgggcataaaaagactcctttgtagatggtcaacaaaggagtgtttatagcagagtatagtatcattctataaagcacacaattcctacgctagttttaactagatcaggttcgaggatttcgcagttgcgatctcagccgaagcactcctttgtgtatatgtaattagtgaaattgtatcattttattcgggtgttgtaaatagtttctgataaacttcattaggatccttcagggtagtaataatgttgaggtctaggtggtgctcaaagccgtttacataaccacgtgaggtatattggtgaagatcgtagttcaagtcagtatttggagcggcattgtagtagccagaatcatcaccgtatgtaggaatccaaatagcgtcaaatttatccacattgatgctgtggtcttccatgaaataggttccgacgtaaattccaatgtttttagcgccgagagtttctaactcttttcgaaaagcctccactccagcattcatatcatccatggtatattcttcgacgtctaaccaatagaaggttggcttgtacttatttgcggccttataaaagcttcgagcttcctctcgcatgttctcaatactatttcccgtgacataggcatagacagcaacaggtatatttcttgcttgaaattctttaatatgggtatcaaaggatttatctaacccatttttatcagtcgcagtattttcgtttttagtgtgtgatccactttgaatacgaacgatggcgccagaaatgtttttgctaagggtatcgtagtcaatttcagacggtctctgccaagcagaaacgtcgatgataggtttcatttcgagcgcatttgcaatgtaataactcgaactagaatttgttgttttagaacttgtactggtgtttgattgtgtgactgcgggttcgttagctacctccgtcttatttacagtatttccagtcaccccagtgatgaaaataagagcaaagaaggataggaaaaaaccaacaacaatcatcggatttagtttctttctcatctcctcaattctaccgtaaaatcatgaaaaaatcaaaaaaatacgattcaagaaatagtaaaagattatctgaacttgacataataaagggaatagggtaggctaaattggtatgcatgacaaaagtgaaaaagtaagacgtgttagtcagctagttgttctgtcctatttcagtttgctggagagctggatattgatgatactagtgatggtagggagtggcttgctttttggatttggcacagttgttttgtggcaagttcttagttttgcttttatccaatttatatggtggttggcaatcggtccttttatcaaaaaagagaacattcccttgtggctacagagtcttctggcggggattcttgtctttttgtatgggctaacgataagttttttatctgctacacagtttgggacttctcctatcgtcttttggcttaatggtttagtctttgatagtttacacgctacttcaacagttttgttttatccaattattgattatatttttaggagattttataaatgaaaaaaattagtattatgttgatggttgtcttctcgctcttcttggctgcttgtacaaacactaccgagaaacagaacaactcggctatcgaagtcactttgcagattacaaccaaggacaaagagaatcgtcaggaagtcactgcggaagaaggtgatagtgtcatggatgtgcttaaagaacatcatgacattgtagaagacaatggtttgataacagaaattgatggtgttagccaagatacgagtaccaatacatactggatgtataaagttaatggccaaatggctgataaaggggcgaaagaccttacagttgcgaatggggatgaaattgaattttatcttgaaacatttgaatagatatgaaaggcttcggcctttttcttgtcgacaaaagtcagttccgaatgtttgcagagcaacttagaaagtgataagtatttttatacaaagtatgctataataagagctatactcgaagaaggttggataagcaatgaagattgacaaacgccagttgttgaattattccatactgattccctatctcatcttatcggtgattgggttggtcatggtctattcgacaaccagtgctacgcaaattattaatggtggaaatccatttagaacagtgattaaccaggcaggattctggattgtcagcttggtagcaatctatacgatttatcgtatgaaattaagttttttacgcaagaaagccgttatctattcggttattttggtagaagtatttctgttagctatttctcggttgtttcctccgattaacggggctcatggatggattcctctgccaatcgcaggaaccttgcagccggcagaatatttgaaattaattatcatttggtatctggcacatgagtttgcaaaacaacaggcggatattcggacttatgactatgtatcgttgattaaaggaagttggattccgaaagagtttacagattggcgggtggtcagtctgctcctcctaggtctagttgcgacactgccggacttgggaaatgcgacgattattgtgctgattatggtcgtgatgattagtgtgagtgggattgcctatcgctggttttcaacagcggttttaggaattgtggccgcctcaacagttattctagggacgattcgtattttgggtgtagaaacggtggaaaaaattccgctctttggttatattgctcgtcgttttgctgcctattttgatccatttggtaatgccaccaactcaggtcttcaattgactcattcttactatgcgatgagtaacggtggatggcttggacgtggtttgggaaattcgattgagaaaaaggggtatctaccagaggcccacaccgactttgcgttttcgattgtcattgaagaactcggttttgttggagctagtttaattctagccttattgttctttttgattattcgaattattattgtaggcgtccgtgctcgtagtccatttaatgcgatgatggcacttggaatggcaggtatgcttctgattcaaacatttgtcaatatcggaggaatttcaggaattattcctgcaacgggggtaactttccccttcttgtcacagggtggatcgagtctcttgattatttccatcgggatagggtttgttttgaatattgatgctagtgaaaaacgtcgattaattgaagaagaaatagagcgtacgctaatttagagataggaaagaggtaggagatggctattcaaaaattagaaaactataacaacaaggaagcaatccgtgaagaagtaacgattctaacatctattttggaagaagtagcagcccaaatgatgcctgcagagacttttgctaaaattgtagaactatctcaattgtctcgtcaagatgattatcaggcattgattgctattatcagtcagttgaataatgatgaactagcggttatttctcgatactttgctgttttgccacttttgattaatatatcagaagatgttgacttggcctatgaaatcaaccatcaaaacaatattgatcaagattatcttggtaagatttcaacaacaattgatatggtttccaaacaagaaaatgcagctgaaatccttgaaaagttgaatgttgttccagtcttgacagcccatcctactcaggttcaacgccagtctatgcttgatttaaccaagcatattcatgagttgcttcgtcgttatcgcgatgtaaaattgggcttgctcaataaaaacaaatgggaagatgagctccgttattacattgaaattatcatgcagacggatatgattcgtgagaagaagttgaaggtaaccaacgaaatcacaaacgttatggagtattacaattcttcctttattaaggctgtcactaagttgcagcgggaatacaaacgtttggccgctgagaaaggaatcgtcttaaataatcctcgtccaattacaatgggtatgtggattgggggagaccgtgatggaaatccatttgttactgcagagaccttgaagctgtcagccttgactcagtgtgaagtcattatgaattattacgatgagcaactctataaactctatcggaatttttcgctctcaacttccattgtaaatgtatctacagcggttaagatgctggcggatttatctgaagatagttctgtctaccgtgaaaatgagccttatcgtcgtgcttttcactatattcagatgaaacttgcaaatacaagagattatttagttcacaataagccgtcagatgttcgctatagtaatgtagccgagtttaaagctgatttattagccatcaaacaatctttggtcgaaaataaatctatggcgctattgaaaggtgattttacagaattgcttgaagcggttgaagcgtttggtttctacctagctagtatcgatatgcgccaagactcttctattcatgaagcaagtgttgcggagttattggcctctgctcgtatcgtagaagactactccagtttatctgaggaagctaaatgccatgttcttttgaaacagttggaaacagatccacgcattctttctgcaacgcacatgccaaagtcagaacaattagaaaaagaattggcaatctttgctgctgcacgtgaattgaaagataagctaggtgaggaaatcatcaagcaacatattatttcacactcggagagtgtttctgatttactggaattagctgtcctattaaaagaagttggtctagtagatgtcgataaggcccgtgttcagattgttccactttttgagacaatcgaggatttagataatgcacctgataccatgcgtcaatatctgcaattagatttagcgaaacgttggattgcaggcaataaatactaccaagaaatcatgcttggctactcagattccaacaaggatggtggctacctatcctccggctggacactctacaaagcacagaatgaattgacgcaaattggtcaagactacggagtaaacatcaccttcttccacggtcgtggaggtactgttggtcgtggtggtggtccttcctatgatgcgattacatctcagccatttggttccatcaaggaccggcttcgtttgacagaacaaggcgaagtgataggcaataaatacggtaacaaagacgcagcctactataatttagaaatgctggtatctgcaacgcttgaccgtatggtcacacaaatgattaccgatccaaatgaaatcgatggctatcgcgaaaccatggatgaaattgtatcagatagctatcgtatttatagagatcttgtattcaacaatccacatttttatgattatttctttgccgctagtccaattcgtgaagtatcaagtctgaacattggctcacgtcctgcggctcgaaaaaccatcacagaaatcggtggtttgcgtgcgatcccatgggtattctcttggtcacaaaaccgtgtcatgttgccagggtggtatggagttggttcaagtttcaaacgctttattgataagcaccctgataatttgtctaagttacaaaaaatgtatgaatcttggccattcttccgttcacttctatcaaacgtggatatggtattgtctaaatccaatatgaatatcgcatttgaatatgctaaaatgtgtgaaagcgaagaggtacgaaatatcttccatgtcattttagatgaatggcagttgaccaaagaaattattttgtcaatcgagcaaaatgatgagcttttagcagaactaccgtttctaaaagctagtcttgattatcgcatgccttattttaatgtgctcaactatattcagattgaattaattcatcgtcttcgtcgtggagaattgagcaaagaacaagagaatctcattcatattaccatcaatggtgtggcgacaggtttgcgcaactcaggttaataggcataaaacaacttcttcggaggttgttttttttgctgataaaaatatataataatcataagaaagtgtaaccaaatcatcccttattcgttctattagtgaaaggaggagatgagtatcaaacttgatcaatatgaaaaagaagtcattggtattgctgaggagatttcctactatctacaaaaatctggcgccaactatgcagatagtcaggacatcgcacaggatatactagtgaaaattttagaagcagagcttgtccttcctttcgaaaaactaagagcttggctttaccgttctgcagttcgggcttacattgacaaatacaggcgagacaagcgctaccatgaaattttacaaaaggagttttttacacctgaaaattttttggtctatgaccaagaagattatgaggaactctatcaagctgttgcagacctgccagaaaaataccagcaagtgattgacttatactacttccaagatatgagtatcaaagagattgcgcatattttaggtgctggtcaaagttgggtgaaaatcagccttcaccgaggacgcaagcagttaaggaaaatactagaagagagaggatatgactatgaagacttttgaagaggtgacaaaaaagagtaagcggaaaaatttatggaagacagttggactatcatcgttcatcggctttatcttattgttgattggcattcaaactgtaaaaataattgtcggtgcacgagaaggtagtgagaattggaaacaaattattttaatggaaatctcttatccaaatataaaacatgacggtattaaaatccaaagcacgagttatgtttctgggaaactttactgcaatttatataaggatctagctggtgttcctatggcttttggtcagcacgaaatttactatgacctgtttgatcgtcactatgattttgctcagcatatacccgggaataccttcaaatatctatatgatttcacaaccaataccaagatacctgttttttacaatagaaaaaagtccgtttggagtgttcaagacattgccaatgaattgcattatcttaaagacatgagtgggcagctagtagaagtggctatttcctttgataagaagtatagtttggcagaaatcaagcaaatgattcccagcaatctcaagcaaaattggtattggatagggacagaagggaagcagaatacccattactatcgtccagagcagcttttggggttagatccagaggatattcaactagtcttttcggatatgcctggagactatatgacaggtatggactttatgaaagagttcttagaatcgggagatcagaaacgagcgcagtatctggacatacctgtggatgacttgcaagcctttgttgacaaatttggcgatacagactttactaaacaagaagagattgataagctagaatttgcaggcattatcctaacaggaaaagcagaagactttgcccagttggaaggcaaggactggatttattcttctagtattggcgcgtccattcctattcagccttattatcaactgcatcattaagtgaaaatagtcaatatattttcaacacctatagcaagaggcttgtcagggagtcgtaggataactgaatggagaaaggtctgtcgcagtggtctcgtatttgtggcaccttgtagctatggtaacatcaatattcttacggaaatgaggtgtttttagttgagtaataggttaaaatgggatgataaaaaaagttataagcgaagctaatagcccttgcagaaaatggataaaataaaaaacgatagaaaatgcttgcaattctgctacaatttgatagaatagtaaggtaaagttagactgtattgcctactgtctatctataaaatatattttattggaggcttttaccaaaatggcaaaagaaaaatacgatcgtagtaaaccacacgttaacattggtacaattggacacgttgaccacggtaaaactactttgacagcagctatcacaactgtattggcacgtcgcttgccttcatcagttaaccaacctaaagactatgcgtctatcgatgctgctccagaagagcgcgagcgcggtatcactatcaacactgcacacgttgagtacgaaactgaaaaacgtcactatgctcacatcgacgctccaggacacgcggactacgttaaaaacatgatcactggtgctgctcagatggacggtgcgatccttgtagtagcttcaactgacggtccaatgccacaaactcgtgagcacatccttctttcacgtcaggttggtgttaaacaccttatcgtcttcatgaacaaagttgacttggttgacgatgaagaattgcttgagttggttgaaatggaaatccgtgaccttctttcagaatacgatttcccaggtgatgatcttccagttatccaaggttcagctcttaaagctcttgaaggtgactctaagtacgaagacatcgttatggaattgatgaacactgttgatgagtacattccagaaccagaacgcgacactgacaaaccattgttgcttccagtcgaggacgtattctcaatcactggtcgtggtactgtagcttcaggacgtatcgaccgtggtactgttcgtgtcaacgacgaaatcgaaatcgttggtcttcaagaagaaaaatctaaagcagttgttactggtgttgaaatgttccgtaaacaacttgacgaaggtcttgccggcgataacgttggtgtgcttcttcgtggtgtacaacgtgatgaaatcgaacgtggtcaagttatctctaaaccaggttctatcaacccacacactaaattcaaaggtgaagtttacatccttactaaagaagaaggtggacgtcacactccattcttcgacaactaccgtccacagttctacttccgtacaactgacgtaactggttcaatcaaattgccagaaggtactgaaatggtaatgcctggtgataacgttactatcgacgttgaattgatccacccaatcgccgttgaacaaggtactactttctctatccgtgaaggtggacgtactgttggttcaggtatggttacagaaatcgaagcttaattcgattgagttcccagaaataacaattatagtcagacaacttaattgtaactctctactttcgggtagagagtttttctgtaagtattcataaaatgcacagaaattctttaatcttagctaagtttatgctataatgtaccttgtaaaataaatatagaagaggtaagtgaaatgtcacgtaaaccaatcattgccggtaactggaaaatgaacaaaaatcctcaagaagcacaagctttcgttgaggcaattgcaggaaaattgcctgcaggcgacaaaattgaagcagctatcgcagctccagctgtagatttgaacgctctcttatggttcgctaaagattctgaattgaaagttgctgctcaaaactgctactttgaagatgctggtgccttcactggtgaaacatctccaaaagtattggctgaaatgggtgttaactatgttgttatcggtcactcagagcgtcgtgattacttccacgaaactgatgaagatattaataaaaaagctcatgcaatcttccgtaacggtttgactccaatcatctgttgtggtgagtcacttgaaacttacgaagctggtaaagcagtagaatttgtaggtgctcaagtttctgcagctttgaaagacttgactgctgatcaagtagcatcacttgttattgcttatgagccaatctgggcaatcggtactggtaaatcagctactaaagatgatgcacaaaacatgtgtaaagctgttcgtgacgttgttgctgctgatttcggtcaagaagttgcagacaaagttcgcgttcaatacggtggttctgtaaacccatcaaacgttgctgaatacatggcatgtccagacgttgacggtgcgcttgttggtggtgcatcacttgaagcagaaagcttcttggctttgttgaacttctaataacaaaaagcatcggattttgaattcgatgcttttttgatattttaagaggctacttcagtacccattctctaaaagcgtgggctacaccgctctcatcatttgatttcgtaatgtatttggcgattttcttcaattcaggatttccgttttccatgacaacaggattaccaacaacttccaacattggacggtcattttcttggtcaccgatggccatggtttgatccatagttagtccaagcttctcagctagatgaatgatagcttgtcccttgttaacagttttaggggtgatttccaaataaaatggtgctgattttgctacgttgtacttctcagtcaagctggtcggtagaagtggaatagcagcatcaagaatttctggctcatcaaccatcattgttttgatgatttccttgtcagccatttcttcaggagtgcgatagaaaatgggtgcacttactagtgtggattcgtaaatggtgtatttaccgatgttacggttggcagtatagataccttccttgggctggcatgcattgggagcttgagtttacgggcagcagattcgatgtcgagataatcctcataagtcaaggtatctttgacaatatcctcaccagttgctgcatcttggactaagccaccgttaaaagtgatgacgtagtcacctgcttctgtaagattgagttcttctaaaattgcttgaacaccggaaatggggcgaccagtagcaataacaattttaacgcctgctttttttgcttcttggattgttgagtgtacttcagctgtaatttggtgttgactatttagtagtgtaccatcaatatcgatggcgacaagtttaatgctcatttgattctccaattataaaatgatcgttatgtatgtggctgttaaaatcagctatttgaggtgcgaaaattcctgtttcttctaacatttcttttgggaaatagaagcggctatcgccatggattgtgcctgataaggaatggacaattggtgatagagaggatagttctaccaaggtttcatctttgcgataaatctcaatttgagtccgtttcttttctgcattcggtcggtaaatgtcatacggcaaatcaaagttgtggtgaatagcagtatagtattctgggtcaaacccgacgtctgcgaccaggctacgcaggcggtccaaagcttcctcttcttcggccttgaaagtgatggatttgagcactttcctattgatatagcgctgggctaagtcagataatatacgatctggtccatctatccatgattgaaagtaagtattcataactccatcatccagactgaggtagtcggttagacggatacgatgctcaaaaaaaggtaatagccgaggtgaagttcgtgcaaaaaactcctgttcaccagtatatagtagtttggcacgattgagtaaattctgcaataggacttccatagagcggcttgctggatgaaaatagacttgcatgtacatctggtagcggctgagaacgtagtcttctactgcatgcataccagattctttgaaggcaattccattttctgtcgggcgaatgacacgtaatatcctagttaggtcaaattcaccatagttcgcacctgtgaagtaggaatctcgtaatagataatccatccggtcaacatcaatctggctcgaaatgagttgaacgacctgtttatttggataggtgtgtttgataacactagcaaccttgtctggaaactcaggtgaaacttgtttcaacagagcattgatttccgtttctggactagtaataatagcacaggtcatttcctcatggtctgtatcaaatagacgctcgaaggtatgagaataggctccgtgtccgacatcatggagtagcgcagcaaccatggtcagtagggactcatttgtatcccagatttgtggatacttgtcttcaaatttttgagtaatccgtctggcgatttcgtaggcgccaaggcagtgcgaaaagcggctatgctcgccaccatggaaggtataggaagtagtccctagttgcttgatgcggcgtagtcgctgaaattcttttgtattgataagtttataaatcagctcatgatcaacatgtacatagttatgaactggatcgcgaaatactttttctatcatagtttcattataacaaaaaagggagataaattcctgatttttctaaaacacaaggatattgctatgtacccaatggaatcttttggtataatggagaaatgaataatcaaattatcttattaactattcaggtctttattgtagccctgattctttggatgctttacacaattctatcctatgctaaaaagcacgatatttctctaaaagagaaattttggacaggatttggtatcggttatgttactgatttgctagacaccttggggattggaacctttgcaacgacaaccactatgtttaaactgacaaagttggtggaagacgatcgtaaaattcctgcgaccatgacaacggcgcacatcataccagtcttagtagaggcgctattgtttattacgatagttgaggttgatatggtcactctgattgctatggcagcagcggcatttacgggtgcctttgttggtgccaaggtaactcaaaaatgggatacaaagaaagttcaacgaattcttgggattttactaattattgcagcctgtttcatggtctatcgcatgattactaaccctggcgcagatcttaccaatgaagtaaagggcttaactggttggaaactggctgttggtattgcctttgattttatggtgggaatgctgatgagtatgggactgggtaactatgctcctgagttaattttcttctcattgatgggaattagtccagcggttgctcttccagttatgatgttgaatgctgctatgattatgacagctggtgccaagcagtttatccaatcaggacgagtaaactggccaggagttccaggaatcgttgtcggtggggtgctaggtgttttgacagccgctttcttcctatcaaatttggatattaataatttgaaaattttagttgtcttcattgcagcgtatacaggttttactctgcttcgttcatcctttgttactaggattaaaaaatagtaggaggaactatggatattcatttacgaaatgaaattgatctggacgggcagattgaggtagtggatcagcaatttcaagtggaagttaaggaaaaagatgggaatctctatctcatttatagtaacgatgaagctgaaaaagttgtcataaaatgtgacgaagaagagttagtgatgacacgcttttccactccgaagtctattatgcgattcatttctggtaaagaagctattgtgaccattcctacaccgttaggaatccagcattttgtgaccgatacaaaacgttaccaattaaaccgttcggatcaaagtgtccagttgcaatatgaattaaagggattggagaaccagcagctttttgcttcctatgatttggaaatctcgtggaaataatggtaaattctcaaagtaagttctagttcccgtccttccagaagttactctgagaaaactgcataacatcaacagaatttagtctcagactaagttctgtttttgactaaaaatgttgataatagtgagttttagggttgaaaatgttgaaaaaagagtacactaaagttactggctctgagacgtctcaaagtaagttctagctatctggaattttggatggaacaagttcctttctattttgaaattattttttgataaaaactagcgattacttatccaataatcgaggtgattgaatgacgttctcagggtcaattttagagattcccaaaagtgttgccaattcctcaccgtaggtaaatgtaaagagttcataggctgattttccgttgaaagaagctcgtttgacgctgttgatatgcgaacaaaccaggttgatgtcctcctgtgtcaagttgtcaaaagaacttcttttaggaagaatatctctgataagtgtgtgattcttctcaattctccccttctggtcagaacgattggggtcacagaagaatagcttagattctccgcgaacatccatttcgatatcgtccactctagcgaattcaccgccattatcggtcagaatgacaggaaatatttcgcaaaagtccatctctttctgatgcaggtcattcttgatagcgtagagatgtttagcgacctcattagctgttttattatcaagtaattgagcgaagataaagttacagaaggagaggttaaaggtgagaagtacctttccgccgatccgtccagtaacggtgtccatttccagccaatagctgattcctttctctgtgagaaagcgttggaagtcctcgtaagaccgtccttctttggcgattttaggaatgggttgtaggtttctgattctccgctttctgaatttcacgacacgggggaaatcaatgggctttgtggacagatagcctttttcaaggtatcggtagatagaagctctggatgccgacatttcgtttgaggcgatgatgtggttgaggtgttgtcccttttggatggcagcagaaacaatctcatccatgcgatagaattcttccttgtttagtgcaacacctgttctcgaatctgagagcttaacttcataatcaagctgagctctttttgcgtagtagaactgtttctggtatccgcagttgcttctctttttcggacaggcattacaaacgtaaggagtctttttgagtagagggcaggcctcacaattggaggtactagagttctcttttatcaccctatttctccgaacttcttttgaaattgtggacggatcttttcctaacttagctgctatagctgagaagggcttaagttgttcaattcctatttgaatatcattgcgatcagagagagttaagtgtttgtttttcattgtcagttaccaacttgtcccatagtaagttctaccttatttctttgtctcagtctaatttccagtttttaagacagactagaacttactttgggaatttacttcgtggaaataatctcttatttccagaaaaatattcttgaatttctcgggatttttgatataatagttaacaaatcgagggagtagctagcggaaaattccgtgatattgtcgtcaatccgacttgtttccggcaatatattaaatagcgagacttgttttaataaaacaggtctcttttttatttgttaggtaaaaaagggaccgagaaggagaaggaaattgtcaaaagaacaaaaacgcgatttgttttatacacagagcgaagagcaagtattgtcaagcatggggtcttctttggacggtttgtctagtgatgaggcaagcaaacgtctagcagactacggtcgtaacgaattggatgagggtgaaaaacgcacactcttagctaaattcttggatcagttcaaagacttgatgattatcattttgattgcagcagcaatcttgacggtgattacagaaggttcacacggtttgacagatgccattatcatcttggccgtggttatcttgaacgctgcctttggtgtttatcaagagggtcaagctgaggcagccattgaggcgctaaaaaacatgtcaagcccagttgcgcgtgcgcttcgtgacaatcatgtagtcgaagttgattctaaagacttggtaccaggtgacatcgtcttgcttgaagcaggtgatgttgtccctgccgatatgcgtttgttggaagctaactccctcaaaatcgaagaggcagctcttacaggtgagtctgtaccagttgataaagatttgtccgcagttttggctgaagatgcaccaatcggtgaccgtgtcaacatggcctaccaaaactctaacgttacttacggccgtggtcttggtgtggttacaaatacaggtatgtacacagaggttgggcacatcgctggcatgcttgctaatgcagatgagactgatacaccattgaagcaaaacttgcaccagctatcaaaagtcttgacatatgcagttcttgtaattgcagcggtaacgatggctgtttcagtcttcgtacgtggtgaaggtatcttgcctgctcttatgacttctgtagctcttgcggttgcggccattccagaaggtttgccagctattgtaacagttgttctttcacttggtacacaggtcttggctaagcgtaattccatcatccgtaagttgcctgctgttgaaacacttggttcaactgaaatcatcgcatcagataagactggtactttgactatgaaccagatgactgttgaaaaagtctatacaaacggtcaattggtggatgctaaagaagctttggatgcaagcaatacaacgcttcgtgttatgaactttgccaacgatacaaaagttgacccaactggtaaattgattggtgacccaactgaaacggcacttgttcaatttggtttggatcaaaactttgacgttcgtgaagtcttggtatcggagcctcgtgtggctgaattgccatttgactcaacacgtaaattgatgtcaactgttcaccaacaagctgctggaaacttctttgtagctgttaaaggtgctccagaccaattgctcaaacgtgtaacgcaaattgaagaaaacggtacaattcgtccgattaccgatgcggataaacaagccattcttgccactaacaaggacttggctaagcaagcacttcgtgtcttgatgatggcttacaagtatgttgatgctattcctgaattggaatctgacgttgttgaaaacgaccttgtcttctcaggtttggttggtatgattgaccctgagcgtcctgaagcggcagaagctgttcgtgtcgctaaggaagcgggcatccgtccaatcatgattacgggtgaccaccaagatacagctgaggcgattgcaaagcgtcttggtatcatcgatccaaatgatacagaagaccatgtatttacaggtgcagagctcaacgaattgacggatgaagagttccagaaagtcttcaaacaatactcagtatacgctcgtgtatctccagaacataaggttcgtatcgttaaggcttggcaaaatgatggtaaggttgttgccatgactggtgacggtgttaacgatgcaccatcacttaagacagccgacatcggtatcggtatgggtatcacaggtacggaagtttcgaaaggtgcctctgatatggtccttgcagatgacaactttgcaactatcattgtggcggttgaagaaggacgtaaagtcttctcaaacatccaaaaaaccatccagtatctcttgtcagctaacactgctgaggtattgtgtatcttccttgctaccctctttggttgggacgtattggagccagttcatcttctttggatcaatttggtaacagatacacttccagcgattgcccttggtgttgaacctgctgaaccaggtgttatgcagcacaaacctcgtggtcgtaactcaagcttcttctcaggtggtgtcttgagttcgattatctatcaaggtatccttcaaacagcacttgtcttgggcgtatatggttttgcacttctttacccagagcacgctggagataatcatgccattcatgcggatgctcttacgatggcatatgttactcttggattgattcagttggtgcatgccttcaacgttaagtctgtttaccaatctatctttaccgttggtccattcaagaacaaactctttaactggtctatcgtagctgccttcttgctcttgatggcgactgttgtgattccaggattcaataccttcttcaaggtatctatcttgacaccaactcagtggatggtaacagtaatcggttcaggtctcatggttgtcgttgtagaaattgttaaatttgttcaacgtaagttgggattggatgaaaaagctatctaatatagttattcagcttatcttttattacttcgttaactcgacttgccgtacttcagtacagcctgcgcctcagttccttgtctgaaagctaattcattcgactatattatttagaccctatcgccctccttaacttgaatgctcgattttttatcccctcgaatgcttagtgtaacagatggttgtgtaattggtaagcttagaattttaccttgagtaactgtcccagcaatttttccatctaccaggagcggaagtttttgggaggatagttgtttgataggttttggataatgaataataactctcatatgaacctccttgtaatctagtttcattatagcaaaaaagaaaaaaatgtaaacgatttctgacactgttttcccctacaggcttgcttgaagaataagaaactgctataattttgaagaggtaggagtttatatgaattatcttcagaattatattttaagtaaaagcagttatttgccatctgataagttattcattctgcaaaaagaactagaagatttagatgatgaggctttaaacgttcttatgatggttgagatgcgtcaacctcttgtcgctcttattttggctattttcttcggtgagtttggtgtcgaccgtttttatgtcgggaataaagaattgggatttgccaagctgattgcttttgcagtatcttttgttacgctatttatcttgattgggttcttgttatttttgggactttatttgtggaagtttattgattgcttcttgatcatgcgagcatgtaaggaagcgaactttgagcgtttgatgctacaaatccatcaatataaggcttttcagcatagcaatcagacattttaagtaagatatttttgggaataaggggaggcttggtagtgtcttccttttctgtttttagtaggctgtaaagtacttgtaatatggaacgagctttgtcacagaagtgacattttatagaacagcatttatgatataatgataaaatatgctagttgagaggagaatttctatgcagacaaagaaaatgagtatgtttttattttttgcctatctccttttacttacttggatgattatctttaagatggacttgagcatcgtatatggacgctatggttatgctagtataaacttaattccgtttgcaggaacagcggtctatgatggagtgctggattttccagaaattctatttaatattgtaagttttattccctttggtatttatatggaaatgctatttcgcaaggcatcgtgggtgactaatctatgtttgattatgttagtgagtctctgctttgaggttctgcaatatcttcttttacttggggttgcagatataactgatttactggctaacggcttagggggagcaatcggtattaatatcatgtatgtcttgaccagtatttggcgggagaaggcctatgttcgtatgaatattttttgttttgtgctaacgttttttgttatattaataacttatttagccatgtaggtcttgctaaatatattcaaagtttgctaaaatgaatataatgaatattaaggaagagattattaaattatctcaggaaatcggaatctcgaagattggttttacaacggctgatgattttgcttatttggagaaatcacttcgtgctagtcaggaagaggggcgttcgtcaggatttgaacacaagaatattgaagaacgtatccgtcccaaactgtcgttagaatctgcaaaaactatcatttctatcgcggtagcttatcctcgacatttgcctgtcaaaccgcagaagacccaatacaaacgtgggaagattacccctagttcatgggggcttgattaccactatatcttgcaagataagatggagcgtttggcacggggaattgagaaactgacggatggtttggaatacaaggctatggtagatacaggagctttggtggatacagcggtcgctcgtcgtgcaggaattggctttatcgggaagaatgggctagtcatttctaaggaatttggttcctatatgtttctaggagaattagtgaccaacctggacatcgaaccagatcaaccagtagattatgattgtggtgattgcaatcgctgtgttgcagcctgtccgacgtcttgtctattaggtgacacgaccatgaatgcccgtcgctgtctgtcctttcagacccaggataaggggatgatggacttggagtttcgtaagaaaatcaagacggtcatctatggttgtgatatttgccagatttgttgtccttacaacaagggaatttccagtccacctgtggtggagattgaccctgatttggctgagcctgagctgattccattcttggacttgtcaaatggacaattcaaggaaaaatttggtatgattgcaggttcttggcgggggaaaaatattctccagcgtaatgccatcatagccttggctaatagtaatgatcgctctgccattcccaaactcctagaaatcatcgataaaaaacaaaatccggtccacatggcaacggctatctgggccttggggcaattggtcaaacagcccaatgatgagatggtttcctttatcgcaggtatttcatcagacaatgatgatgtcatagcagagcaagcggcctttctcaacatggtcaaggacttgcaaatgtgatataataaagattatgaataaaaatgaggtgtatatggatacagcagaaattcgccaaaagattgaagaacttggcaaaaaattaacttcttttagggggtctctttgacttagaaggtctggaagaagagattgccattcttgagaacaagatgacggagccagatttctggaatgataatttggcagcccagaagacgtctcaggagttgaatgaattaaaaaatacttatggaaatttccatcagatgttggatttatatgatgaatctgaaattttgctagattttctagcagaagatgagtctgtgcgggatgagttggttgaaaagttagtggaattggacaaaaccatgactgcttacgaaatgaccttgctcttatcagaaccctatgatcacaataacgctatcttggaaatccatccaggttcgggtggtaccgaggcacaagactggggagaaatgctcctgcggatgtatcagcgttatggaaatgccaaaggttttatagtagaaacattggattatcaagctggtgatgaggcaggtattaagtctgtgactctaagctttactggtccaaacgcctatggcttgcttaagtcagaaatgggtgttcatcgtttggtgcgcatctcaccttttgactcagctaagcgtcgtcatacttcctttacatctgtggaggtaatgcctgagttggatgataccattgaaattgaaatcagagatgatgaagtgaagatggataccttccggtcaggaggtgctggtggacagaacgtcaataaggtttcaacgggtgttcgattgacgcacattccgacagggattgtgactcagtccacagttgaccgtactcagtatggaaaccgagaccgtgcaatgaaactcttgcaggctaaattgtatcaattggagcaggagaagaaagcggcagaagtagactcacttaagggtgacaagaaagagatcacttggggaagtcagattcgttcttatgtctttacaccttatacaatggtaaaagaccaccgtactggttatgaggtggctcaagtcgataaggttatggacggagacttggacggctttatagatgcttatttaaaatggcgaattagctaagaacctgtatttacaagtgaagtgcttgtaaataagagatagtttttcgctcatcaaggaagtttttttagagaatacggactgtattttgaaaaaaacgttctcaaatctaaagaaaggactgtctaagacaggaaatcctatgggaataatagaaatgaaagacgtttccaagaaatatggaaacggaacgactgcccttcgcggagtatcagtcaatgttgaagcgggagaatttgcctacattgtaggtccttctggtgcaggtaagtcaacctttatcaaactcttgtatcgggaggaaaagctcgataaggggagtctaaaggttggtaagtttgaccttgcaaaaattaaaaagagagatgttcctcttctacgtcgtagtgtaggagtggttttccaagactacaaactcttacctaaaaagactgtctttgaaaatattgcttatgcgatggaagttatcggtgagaaaccacggaatatcaagaaacgtgtaatggaagttttagatttggttggtttgaaacacaaaattcgttctttcccaaatgaactttcaggtggtgagcaacagcgtattgctattgcccgtgccattgtaaataatcctaaagtattgattgctgatgaaccaactggtaacttggaccctgaaaactcttgggaaatcatgaatctattggagcgaattaacttacaggggacaacgattttgatggcgacacacaatagtcagattgtaaatacacttcgtcatcgtgttattgcgattgaagatggtcgtgtagtacgtgatgaagcggaaggagaatatggatacgatgagtaatcgattttttagacactttattgagtcattgaagagtttgaagcgaaatggttggatgacgattgcagccatttcatctgtagccattacccttaccttggttggtctatttgcttcagttattttgaacacagcaaagctcgcttcggatttggaacagaatgtacgcatcaatgtgtatttgagagcgaattcaaccgatcaagctgagacgattgtgaacgaagcaggagagacggtagctaatccagattataaaaaggtgtataatcagattacagccttagaaaatgtacaatctgtcacttattcaagtaaggatgaacagttacagaaattaacagctaccttgggagatacttggaacctattccaaggagatgccaatccactttacgatgcttatatcattgatacgactgaaccgcaatatgtaaaaactgttgcagcagagattgctaaaattgatggtgttacagaggtacgggatggggaagttgaaacggaacgtatttttaaattagctaatctagttcgtacatggggattggcagcaactggcttattgctctttactgctgttttcttgatttccaatactattcgaattaccattatttctcgtagccgtgaaattcagattatgcgtctggttggtgctaaaaacagttatatccgtggaccattcctctgggaaggtgcctgggtaggtctcctcggagctattttgccttctgctttagtctattctttttataagatgatttatacttcggtaaatgctagtcttgctagtcaagatttgtctctgattagtatggatgtctttgttccaggaatgattggcgcactttttgtaattggtattattattggttccttgggatcagtcatttccatgaaccgctacttaaaaatttaatagacaagctacatgtaaaaaggtctgcacaataatgaggcagacctttttgttatggatgtctatggtgagaagattcgttcatctcttgcttaatagtacagtcgcaggaacaatctccgcaggatccttttcctttgatgagactgcgaatcgcaagagaaaataagatgacgatgatgagaaagaggataagtgtgggcattaatattctcctttttctaatgtttttagcgtgacgattggaagagtgttggttggttttttcactaggctgtagatggctgtgataattagaaagatagcgataaatgtccagacggttggtaattgtccgtggataagtacaagaccaatctgatagataaccaaactacttgcataggctaaacccgtttggaaaccgatagcaatccatgtccacttggcttctcccatttcacggtgaatggcaccaatagccgcaaaacaaggggcacagaggagattgaagactaggaaggagtaggctgataacgctgtatagtcttgttgtaaaagcccccatagttcgggattttcttcggttgtttctcctaatttatagaggataccaaaggtggcaatgacggtttccttggctaagagacctgtaatggctgcaacagttgctcgccaatttccgaaaccaagtggggcaaagaggagagaaaaactgtgtccaatggaggctaagatactctcatctgtttctaccatttgtaaagaccaattataggaactgctgaaccaaataatgatgttggtcacaaatataatggtaccagctcgtttgataaaactaagtgccttatcgaatgcataccggagaaccgtactgagttttggtaagtgataagatggtaattccatgataaaggggcttgcgactccaccaagttgcttggtcttttttagtgccattccggataggacgatggcagccataccgacaaaataggcgcttggagcaatccaaggattgtcaggaaagaaagcaccggctaccagtgaaatgataggaagtttggcagaacagggcatgaaggttgctgtcataatggtgatttttcggtcctgttcattttcaatagtccggcttgccatgactccaggaacgccacagcctgtggaaatcaacatgggaataaaggatttgcctgatagaccaaaacgtctaaaaatcctatccatgacaaaggcgactcggctcatatagccgatgtcttccaagattcccaagcagacgaagaggacgaaaatttgtggtacaaaacctagaatggctccgcatcctgcaataatgccatcaaggaccagagattgtagccagccagcgatttcaaatcgatctagatttgcctgaataaggcctggaacaagctctccgaagaggacatcattcacccagtcagtccccattgtacctaccgtttgaatagacaggaagtaggtcagccacatgactgccgcaaagatagggagggcaagaaaacgattggtaacaagtcggtctatgttatcagacaggttaaaagccttatcgctgtcttttgtgaccagttctgtgattttctcgataaattggtagcgttgattgacgataatggcttccatatcgtctgcgtaaattttttccaaaatggcaatgatttcggtcaaatcaagcatgtcttgtgcatttagttgcaattggtctagaatgacttggtcttgttcgagtagcttaatggcgtagaagcgtttttgacgatttgggatggaatccgataataggtcaataacttgggcgaggccggcttcaaattgtttgtcatactgaggatagattggctcggcttgctgattggtaattttttctacttcatggaggagctgggatatacctagcttttttagtgcactgataggctgtacaggaactcccagttgataggagagctggtcgctgtttattgagcgaccttgacttttcagggcgtctgtcatattgagggcgataacaataggaaggcccatttctaataactgcaaggtcagatagagattccgttccaagtttgttgcatcaaggacgttgaggatagcagctggttggtccgctatcaaataatctctggcaacccgttcttctggtgtgtagggagacagcgagtagatacctggtaaatcttgaattagtaaatgttttcgctttttgatcgttccagattttctttcaacggtgactccaggccagttaccgacacgttggttggttcctgttaggaggttgaaaagagttgtttttccgctatttggatttcctgcaagggcgatgtgttttgtcatttcctcacctcgcttgtgatttgaacaccaatcatttgcgcttcggatttgcgtagtgtcagctcgtatcctctcaaggtagtttcgattggatcgcccaggggagcgacttttttgagaaatagctgcgtgttctttgtaagtcccatatccatgaggcgacgacggagtgcacctgttgcatagatgtccataaccttagctgagctaccaataggtgcctcggatagattgattatttccgtagctgacttttctgttaaaaccagagattcaataatttctctgtctagggctagacggcttgccttgacttggaaaattgcattggtcttggtttttgaaatgatgcgaatctcttctccgacttttaaacccaagtgtgctaagtgtttacgaatatcatcttgcgttagacaatctttgactaaataagattgtccaacttgaaggttttgcagtttcatatcgtttcctttgtgatttttataacaatagtatagcacaattccttaaaagtgtcagacaatttttaggaatgacttattttctctttatttttctcaatatttccaaaaaatccattgactttttttagagatatgatatactagtcaagtactgctggtttagctcagtcggtagagcgcatccatggtaaggatgaggtcgccggttcaatcccggcaactagcatcgaatactatcgaaaggccttgtttgacaaggttttttcttatttttgtcctaaattcgcccttattgtcaaaaaatcccttgacatgaatgtttattatggtagaatagggcttagaaatatgaaaggagtaaaacaaatgaacaagcaacttgtcattcagcaagctattttttatcatacactcctttctaagcaggaaaacaaagctcattgatgaacttttgtcgtttttcgtgggctatattttgaaacattgagacaatcaagcactgtgggtatggtgtgataaaaattgtcgactatgttcaagagctggtctatttttgtggacttacgcaagcctaggtggagtgagatgcttccctgggcttttttgtgcgcttagcttagaaaagtaaggtctatcaattgtagcttattgaataaagtggcaaatgataggttatggatttgtaaaggagatatatgtttcgattaatttttgactatatcaagcgtcataagtggctctatctattggttgctgtgaccttgattatttatgacgccacacttttgctaccaacgcaaatcattcagcggatggtcgatatactaaccaagaatgaattaacacaggccatattggttcaggagatgaccttattgttattggtaacagtgctgaactatgcaacagccttcatttggcatctgaaattatttcaggcctctgtcaatttcaagtttgatatgcagcaacgtgcctttaaaaaattagtgaccatgcggactccattttatgaaaaattccgctcaggagatgtcatgactcgtttttcaacggatgtggatggcctgatggagatggtgggttacggtcttatgattgtcgtctatgcaggcggtatgttggcttttatcattcccacgatgttctttattgattggaaaatttcgctagtagctttactaccgatgctgttcatgacactatgtatattttttatcgggagaaaacaagataaggcgattgatgccaatagagaagctgtagcccagctcaataatgaagttttggaggtcatcgaaggcattcgagtgactcgggcttatagtaaaaaagcaaatcaaaaggctcaatttcaagctcgtaccaagcaattggctcaaggtggggatcgcatcacttccttgcaatcattgtataatccattagccacagtctgtttgggattgtctactattttcgtacttctcatgggggcacaagccgtgaaagcagggcaactgaccttgggacaagtaattgcccttcaattgtatgtcggttcgcttttagagccgttttggacactagcagatttcatccttgtttatcagactggtaagacatctttcgaaaaactgcaagagctgattgagacgggtgatgatttggaggctgatggttctaaggaaattgcagagctgtctagtatttccttcaaaaattatagctttagttatccacaggcggaaagagccagcctacaggacatcaattggacactgaaagcagggcaaactgtaggtatcgttgggaaaactggttcgggaaaaacgaccttggttcgccaattcttacgccagtatccgattggtcagggaaattttttcatcaatcatcaatctattttagactttaaacgttctagtatagaggaaaaaattggctatgttccacaagaacacattttgttttcaaggtctgttggagaaaatattgccctagggaaagtagctagtagctctgaggagattgaacaagccattgccacagcagcttttagtcaagatttaaaacggatgagtgatggtcttgataccatgattggtgagcgtggtgtgtctatttctggtggtcagaaacaacggatttccattgcccgtgctttcctgcgagagccagatttgctaattctagatgattctttgtcggcagtggatgctaggacagaacgccagattatccaaaatattcaaaaagaacgtgcaggcaaaaccaatgtcatcgtgacccatcgtctatctgctgtcaaccatgcagactgggtactagtcttggatgaggggcgtatcgttgaggaagggcgtccagctgatttgcttgcccaaagaggttggtactatgaacaataccaacgacaacaaagccaggaaggaggagagtaatgactattttaggttttttattaaaacaaatccgtcgagtcaagtgtctatttatagtagctgtcggcttctatctattggcttcgaccatggttcgattggctcctctgctgattcagcaggcgattgatgggccgattacggatttgagcaagggtttgccttttgatgaagctgttttcttaaaccagtcagttcaatacatgggaatgattattctgggagctattggcttctacttatctatgcgtttactcatgcattgcgccaatcgtattgctgaaaatctacgtaatcaagcctacgatgttatgcaacggttgcctatttcttattttgatgataagcccgctggaaaaattgcaactagaattgtcaatgatacagaaactctgcggacacaattttatgggaccttagttaatgcctttaacaatattgttcgtttgctctttacatacggtgtcctattttatatgaataggagtcttggttggctgatgttactcttgataccactctatatcggtattcaatttgcttacaagaaaatgacagacaagccgatgaaggatttttatgatgcaaggagtgacgtcaatacgcaggtgaatgagaccatgaatggtgcaagtttgattcaactttttggacaagaagagcgcatcatgaaagaatttgaagtgactgctgacaagatgcgtcgggcagataataagattatctgggcccagtctcttgccacgtggaatctgagtggttttctgcaaaatttggtcattgctgcgattttaacggtagtcggctatcaatttcttgcgggacaggatggagttacagctgggaaactctttgtttatgtcaactatatcgaaggagtcttcattgctttgggagcgctggttcaacagttcccaaatatgcttcgctcgtttgaaacaggtaagcgtctaatggcccttctagaagaagagctggaggacgactgtgatcgtattttggaagttgaacaagggcaagtcgtgtttgaacacgtgaactttagctatgaagaaaacagaccagttttgaaagatattaccattcgagcagaaaaaggagaaacagttgctctggttgggcatactgggtctggtaagtcttctattatgaatctcctctatcgtttctatgatccacaggagggatgtgtactgattgatgggaaaaacatccgtgattattctcgtgaaagcctgcgcagtcacatggggattgttttgcaagatccctatctctttacagggacgattgccagcaatgtttccatgaatgaagaggaagcagatagaacaagaatcatgcaggcgctagaaaaagttggtgcagggcctatgctatctcgcttagagaaagggattgatgaaccggttgttgagaagggggcggccttttcaagtggggaacgtcaattgattgcctttgcgcggacactctactctgatcctaaaattctgatattggatgaagcaacttctcatattgatacggagacggaagaaattatccaacatgccatggaagtggtgaaagaaggtcggacaacctttattattgctcaccgactttctaccattcaaaatgcagaccagattcttgtcttagatcaaggtcgaattattgaacatgggaagcatgaagaattggttgcacgtggtggagtatatgctcaaatgcatgagattcaagcaaaggtgtaataagcagttaaaaattccaagcttttgctggaattttttgctataattgactcatgaaagccttaatttttgatgtagatgatacgctttatgatcagattcaaccgtttgaacgtgctttggaaagacacattgaagtagcaagggagcaaattgaaccactctacctttcctttcgcagatatgcggatgaagtatttgaagcgacagcaattggaaagatgagtttgaaagacagtcatatttatcggatgaaacatgctttggcagattttgggtatcaggtgtctgatgcaacagccttagctattcaaatagattatgattattttcaagggcagatagagctcagtccagtgtttccagaaatattttcgtggtgtcaggtgcaaggaattgcaatggggattattacgaatggaccttatagacatcagttgagaaagatacgcacgatggggttagttaattggtttgagctagaacatgtccttatttctggacaagttggtatcacaaagccaaatcctgctatttttcaactaatggaagaacgtttggggatgtcaggcgaagatatttgttatctaggggattcgtttgaaaatgacatcatcggggcaaaaacagctggttggcaagcggtctggtttaatcacagaaaacggtcagagccagaaagttcctttcaggcagattatatgattgacgaatggttcaatctggattcccttatcaaaaacatcataaagccgattggataaataaaatggaataactctcctaacaagtttttaataggattagaagctagtcgggggagtttttgtgttcaaaaagaggaggtatagtcatttagtttatctttaattacttcgacgcaagaggaaactccgttttcttatttcctacttcaaacactccactggattgtttgaactcgctttgccgtactccacgaaagtgacttgcttcgcatgtcttatttccaacctagaacagcctctaggctgttctagcaacctgcagctcgttgccttgtactaaaagcgaactaaacaactataatatctggttatcattgcaaatatttataagtgataatgtgtataaaaaactgacagaaattcagaaaaaacagaaaatgaataggttgtttacagaaatattccggaaattgttggaaaaacaacaaatagagaggcgtaatctgttttttgtctgtttttcatctcaaggagtcttgacaacttatctaaaaaggtgcagaatgaactcgcaaacgtttgtttttttaataccattttttatgtctattcatttcattagtgaaaacatgaaaggataaaacttatgagaaaaagttcgcacttgattttaagctcaatagtcagtttggcactcgtaggggtcacaccattgagtgttcttgcagattccaaacaagatattaatcagtattttcaaagcttgacttacgagccacaagagattcttacaaatgagggagaatacattgataatccgccagcaacaactggtatgttagaaaacggacgttttgtagtacttcgcagagaaaagaagaatattacgaacaatagtgcagatattgctgttattgatgctaaggctgcaaatatttatccaggtgctttattgcgtgctgaccaaaatcttctggataataatccaacgcttatcagtattgagcggggagatctgacgcttagtttgaatttacctggtttggccaatggggatagccacactgttgtaaattctccaacaagaagtactgttcgaacaggggtgaataaccttctgtctaaatggaataatacgtatgctggagagtatggcaatacccaagcagagcttcaatatgatgaaacaatggcatacagtatgtcacaattgaaaacgaagttcggaacctcttttgaaaaaattgctgtaccattagatatcaattttgatgccgtgaattcgggtgaaaaacaggttcagattgttaactttaaacaaatttattatacagttagtgttgatgaaccagaatctccaagcaagctttttgcagaagggacaactgtagaagatttgaaacgaaatgggataacagatgaggtacctcctgtttatgtttccagcgtttcttatggacgctctatgttcatcaagttagaaactagcagtaggagtacccaagttcaagccgcatttaaagcagccatcaaaggcgttgatattagtggcaatgctgagtatcaagacattctgaaaaatacttcattctctgcttatatttttggtggggatgcaggtagcgcggctactgttgtgagcggaaatattgaaacactgaagaagattattgaagaaggtgcaagatacggaaaactcaatccaggtgttccgatttcgtattcaaccaactttgtcaaagacaatagacctgctcagattttgagcaattcagagtacatagaaacaacttcaacagtccataatagcagtgcattgacattggatcattcaggtgcttatgttgcgaaatacaacattacttgggaagaagtatcttacaatgaagctggagaagaagtttgggaaccaaaagcttgggataagaatggtgtaaatctgacctcacactggagtgaaaccattcaaattccaggaaatgctcgcaatcttcatgtcaatattcaagaatgtacaggattagcatgggagtggtggagaacagtttatgacaaagatttaccacttgttggtcaacgtaaaataaccatctggggaacaacgttatacccacagtatgcggatgaggtgatagagtaatctggcaatgtattatactctcttagccacagaggctaggagctaaacactattcgtcagaaacttatcacaagaaaatggtattaaaataaggattctattcaaattttgggtagaatcttttatattttcctaaaaactacttttaggtatgagaactcgttctgaaactattttcaggattttttgtatttctacaaaaatcgaaattacattctaaataaaaagaggttattgaaaaaataataatatactatataataaacaatgtaagcgctatctctagtatggagcagaaaggaatgacataatgggcactattagtaagacagatttaaagcaacaaattaaggatggaattatcgtttcctgtcaggctttgccaggcgaacctctgtatagggaagaaggcggtattatgcctttactagtcaaggctgcccaagaagcaggggctgtcggtattcgggccaatagtgtacgagatattaaggagataaaagaagtaactactttaccaattatcggaattatcaagcgagactatcctccacaagagccctttattacggctacgatgcgagaagtagacgagttagcagctctagatattgaagtcattgctcttgattgtaccaagcgtgagcgttatgacggactcgatattgttgatttcattaagcaaatcaaggaaaaataccccgaacaactttttatggcagatatttcaacctttgaggaaggattaactgcttatgaagcaggcatcgatttcattgggacaacactttcggggtatacatcctatagtaggcaggaggagggaccggatattgaattggttgaccgcttgtgccgagcaggtatcgatgtgatagcggaaggaaaaatacactatcctgaccaagtaaaaattattcatgatttaggtgtggcaggaattgttgtaggcggtgcgatcacacgtccaaaggaaatcgcagagcggtttattagtgctttacataaataataaataggttatagaaaggaatggagtatgaattttaagaagttttctcagctaggtcaggcctttatgctgccaatctcaattttgcctgttgctggtctcttactgggaattggaggcgctttatcaaatagtaatgctgtagcacaatttcctgtattggatcaagcgtggttgcaagctgtattcactatcatgagtacggcaggtagtgcggtatttgcgaatttagcattgatttttgcaattggtgttgctgtaggtttggcagatgctgataaggggactgctggcctatctgctggggttgcatacttggtttatacggctactattagtggatttttaactctttttgctgataagggagcaagcattgatactggagttttgggcgctttagcgattggtatcactgttgcaactttacacaataaatatcgaaaaattgaattaccagcctttcttggtttcttcgggggctctcgttttattccaattatttcatcatttgcagcaattgcgattggctccattttttatataatttggccaccgattcagaatttattagttgattttggtaaggcaatagcagagatgggaagttttggaaccttcttatatggttttggattgcgtttgacaggtgcatttggcttgcaccataccatctatccaatgttttggtatacttcattaggtggaagtgaagtggtagcaggtgagacgatccaaggtgcgcaaaatattttctttgctcaattagcagatgcgaatcacacaggcttatttacttatggaactcgattttttgctggtcgatttgcaacgatgatttttggtctaccagcatcttgtttggctatgtatcacgcaattcctaaggaaaatcgtaagaaggtaggcagtttttattcaagtagtgcattaacttccctattgacaggaattactgaaccaatcgaattttctttcttgtttgttgctccatggctatatgttgttcacgcatttttagatggactatcattcttagtcgcagatctcctgcaaattcgtattgggaactcattttctggtgggcttattgattacttgatttttggtgttttccaaggaaatgacaaaaccaattggatttacgtgattcctgttggcttgctttgggcagcagtttattatctagttttcaaatttttagtaaccaaatttcacgtgctagttcctggtatggaaagcagtgaccaagcatcacattcggaaaaagttttatcaaacggttctagtcttcgtgataatgcaattgctatcatcgatgctcttggtggagcagataatattgagaatgtgactgcctgtgcgactcgattaagagtatcgctcagaaatagtggtcttgtggataagggagttattcagtctataggtgcaacggctgttttggatgtaaaaggaggaatacaggctattttcggaggtaaggctattctgtatagccaagaaatcaatcaaattcttggtcttgaagaatagagttatatttaagcgaattaaaagcattcaaactgtacctatcgggtatttttgaatgctttttgttttattaagattgttgtgaaatagaaagacggatgaattattctctaatggtttgcttgaaaatattctcttttttctccttgtcaatagctaaaaaataggcgtagataatatctagcatgatgagcagggggatttggggtgagatacgattgccgtaattgaggtggcggacagaggcgacaggaatgatttggtcaaaagtcggatggggaaaactcctagttgttaacagggcggtaggaatccccttttgagcagccagctggagatgctccatgacctcttctgtctgaccagacagagaaagaccgataaccaggcaactatcatccagaatattggtagtccagatgagattgttttcatcagtaattgcatcacagactacacccagtcgcataaagcgggatttgatttccattgcaaccaaaccagaactgccgattccgtaaaaatagacacgcttgctactgtcaatcagtttggcaatctcttctaatttttcctcatctaccagtttattggtagcagttaggatttcctcatagtctaccaagactttttttgttaggctccgctgtaatttttcaaaatgtttatccaagtattgttggttattctgaaaggcaaagacaaattctcgataaccggaaaatccacattttttggcaaaacgggtaagagcagatggagaaatgtggagttgctgtatagtgttttcttggctaagatcggcgctagatgggtctaactgagtaaaataactggcaatctgcttttcaagtctagtcatctgatccagatgagactcaatgatggcagtaatgtgtttcggtgtttgtaacattttccattcctctgatagcttctgaggacattataccactaaaaaaccctcattgataggttttatgatataatggaaacgtaaaaggaatgtaagattatgtatattgaaatgattgatgaaacagggcaggtttctgctcaaatgcaggagcagattacggaattgctccagtttgctgccgaaaaaattggcaagcagaataaggaaatggctgtgacctttgtggacaataagcgtgtccatgaggttaacttggagtaccgaggaattgaccgtccgacagatgttgtcagtttagaatataagccagagtcggagattgtttttgatgaggaagacttactggacaatcctgaattggctgaaatgatggaagatttcgatgcctatattggtgaattgtatatttctatcgataaggcacgtgagcaagctgaagattatggtcatagctacgagcgcgaaatgggctttttagctgtacacggttttctgcatatcaatggctatgatcattatacgccagaagaagaagcagaaatgtttggtttacaagaagaaattttgacggcctatggacttacaagagaataattcaaaaaatcgctggaaaaaccgagaattgattgctagtctagaatttgcagtaacaggtttgttgacagctttcaaggaagaacgcaatatgaagaagcacctggcttcagctgtccttgttgtgcttgcgggacttattttccaagtatctgtgacagaatggctcttcctcttgctcagtattagtctagttatcgcttttgaaattgtgaattcggctattgagaatgtggtggatttggcgtcagactatcatttttctatgttggcaaagaatgcaaaagatatggcagcaggggcagtcttgtttgtgtcaggatttgccttgttgacaggattgattatctttgtgccgaaaatttgggactttattttttagaatataaggagaatacatgacatttaagtcaggttttgtggcgattttaggtcgtccaaatgttgggaaatcaacatttctcaactatgtaatggggcagaaaattgccatcatgagcgacaaggctcaaaccacccgtaacaagattatgggcatttatacgacagaagaagagcagattgtcttcattgacacaccaggaatccacaagcctaagacagccttgggtgactttatggtggaatctgcctatagcacccttcgtgaagtggatacggtcctctttatggtgccagccgatgaaaagcgaggcaagggtgacgacatgattatggaacgccttaaacaggccaaggttccagtcattttagtggttaacaaaattgacaaggtccacccagaccagcttttggaacagattgatgatttccgtcaacagatggacttcaaggaaattgtgccaatttctgctacccaagggaacaatgtcaaccgactcatggaaattctcaaggaaaacctggacgaaggcttccagtatttcccggcggaccaaatcactgatcacccagaacgtttcttggtatctgagatgattcgggagaaggttctacacctgactcgtgaggaaattccgcactctgtggccgttgtcatcgagtccatgaaacgtgatgaatttaccgacaaggtccacattcgcgctacgattatggtagagcgtgatagccagaaaggcatcatcatcggtaagcaaggagccatgctcaagaaaatcggctccatggctcgtcgtgatattgaactcatgctaggtgacaaggtcttcctcgaaacctgggtcaaggtcaagaaaaactggcgagacaaaaaactcgacctcgccgactttggttataatgagaaagagtattaaaaacgtccgggggacgtttttaacccgagcttggaaactagagagcgaggaagttcgagggagtgaaacagtctgtgaatagactgtttcagctggtcacatagaaatgttaaagtggccatttgaaaaaaccgagcttgaaaactagagggcgaggtagttcgggggagtgaaacaatctaggaatagactgtttcagcaggtcacataggaatgtgaaagtgaccatttgaaaacccgatcttagaaattggaaggcgagatagcctggggataggctgtctaagtcaatcacttagaaatagttagcagaaaagccgaaaggcttttactgcgttatggagaaatctttttagtaaacaagaaaggaaagccgattaggcgttgtcttgaactcgcctacgactctttgaaaatcacaaccgtgacctaggtgccgaagcaccgtcggtcaggtttctatttgctttgtaattttgttagaaaggatgagtgtttgcgtacttgaacccgagctaaaagctcggaaaatagatagagctccttgtgtgcaagtcacacagcgtcgctctcctaattttcagtcgctttttacgctcttggtatcgtaaattgcccgaattgcctgaggttgagacggttcgtcgtggtttgaatcgtttggtcaagggaaaagttatttccaaggtggaggtgacctatgctcccatgattaagacaggtgtggatgccttctgccaagacttgattggtcaggagattttagatgtggaccgtcgtggcaagtatctcttgatttacctgacagaccatgtcctcatttctcatttgcggatggaaggtaagtacaatttctttgctgaccaggtgcctgccaacaaacatttccatgccttttttacttttatagatggctcgaccttggtctatcaagatgtccgcaagtttgggaccatggaactgctgggtaaggcagatgtggatgcctattttatcagtcgaaaaattggtcctgagccgacggaggaagattttgacttagaagaatttgccaaaaagttagctaagtcgaaaaagcccattaagtcgcatcttttggaccagtctttggtggctggtttgggcaatatttatgtcgatgaggtcttgttcaaggccaaagttcatcctgcacaaacgagtaatcagctgtcgacagatcaggtggcagacctccgtcaagccaccattgaagtcctgcaactgggtattgaaaaaggtggttcaaccattcggacttacaaaaatgccttgggcatggatgggactatgcaggattatttacaagtttacggaaagacagggcaggcctgtccccgttgccagacagagattgtcaaaatccagctgggcggacgggggacacatttctgtcccaagtgtcaggtgaaacatggctaaaattatcggtttaacaggcggaatcgcctctggaaaatcaacagttacagcttttctgagagaacaaggttatccagtcattgatgcggatgcggttgttcacgaattacaggccaaaggtggcaagctctatcagattttgctgaaagagtttggtccagacatcttgtcggcagatggacatttagacagggtcaagctgggtcaggctgtttttgcggatagcaagttgcgggctcgcctgtctgacctgcaggaccaaattatcaggcaggagctgttagacagaagggatgctctaaaacagacggagcaagttcttttcatggatattcctttgctttacgaggcagattatagcggggaagtaaatgaaatctggctagtttatgtcgatagagcacagcagttggaacggcttatgaaacgtaatggcttagctgttcaagatgcagaaaatcgtctggctgctcagctttctttagaggaaaaacggtcgcaagcccaggtggtgattgacaatagcggagcggttgaggcgaccttagcacaggttgctcagcttttggaggaattaaaggatggacgacggtagtagttattggaagcagaatttgaaggtggcttggttgggaaatttcctaacagggacgagttttaccttggttatgccttttatctcagtttttgtggaagagttgggggtaggtcctggacaggtagaatattatgcggggcttgcggtatctgttaatgcccttgcggcagccttgatggcacctatttgggggagtttggcggaccgttacggtcgcaagcccatgatggtgcgagcggcctttgccatgatttttactatgggtggtatggcctttgtaccaaatgttttttggttgcttaccttacgtgtcctaaacggggtatttacagggtacattcccaatgcgactgccttgattgccagtcaggttccaaaggataagacggggtatgctctggggaccttatcaacaggtgcggtagcaggtaatttgattggtccgaccctaggtggtatcttagcagagatgtttggcgtacatatggtatttttgctggtgggacttctttatgctatcgttgtgttactgaccgttttctatattcgagaggattttgttccagtcaaaaaaggcgaagagatgtcggttaaagaggtatttgagcaggtgaaagatcggcagatgctggttgggctttttgtgacttctatgattattattgcagctgctcaggctgttgttcctatattgaccctctatgtgcggcatttgggacagacagataatctgttatttgttgctggttttatcatttccttgcctggtatggcatcgctagtgacatccggttatttagggaaaattggtgatcgtattggcaaccatcgacttctattaattgctttgacttacagtctgttgattaatgttttctgtgtttttgcagaaaatcctttccagcttggtttgttgcgattcatgtatggttttgggacaggagcactgttgccttcggtcaattctcttttgaccaagttgacaccaaaagaaggaatttcaaggatattttcctacaaccaactctttaataatctaggttctgttgttggtcccatgatggggtctgcggtagctgctcacatgggttatgactgggttttctatctgtcgagcggacttgtcctctttaaccttatctggtctttgaccaattttagaaactatttgaaagtaagggatgtttagtgagagttaaaatcaatttacaatgttcagaatgtggtagtaagaactacttgactagcaaaaacgccaagactcatccagataagattgaagtccttaaatactgcccaaaagagagaaaagtaaccctccaccttgaaactaagtaggttttatggtataatgtcataagttattgtagaaagtgaaaaaaatatgtatcaagcattattagcaattctgttgattttatctgttattttgattgtagtgatttttattcagccagcaaaaaaccagtctagcaacgtctttgactcttctagtggagccttatttgaacgtacaaaggcccgtggttttgaagcggtgatgcaacgtattacggctattctgattttcctatggatgttggatgcgctggcacttgttatcatttcaagtaagtagataaatcagactgggacttgttcttggtctatttttttgggagtgggccagaactcgacaagtataaagagttcgtctgcccacctccgcataagttgaataggtatggttcggagcgttattcgcgaactattgagatttgctttgcaaatcctatctcccacctccaacaatcatttgattgttggagcaatcaaccactgcgtctggatataacgcaaaatacagtcttttagtttgcttttagtactaggcaacgagctgcagactgtactgaagtacgacaaagcgagttcaaataatgatgaaattatttgaagttggaaatagggaaacggagtttcctcgtacgtcgcagtaataaaagataaactaaaggactgaaagagaaatagtgctagattcttaactagcactctggtaaatacaagatgaaaaacgaaattataaactatattaaagaagttggtcctgtgaccatggaccagctggcagatcagtttggagccagttctgctaagagctttacagacttggtcaagctggtttctagcatggaaggcagtcgtcaacttgtctttgataatgctgggcggattactcttcctgctccaaaaatctctaagaacaaggtaaccttacaggggattttccgtgctcacaagtcaggttttggctttgtgaccattgatgaagaggaagatgatctctttgtcagccgtgacgatgtcaacttcgctatcgagggcgaccgagtggaagtggctatcaagaaagtggcggacaggttcaaggggacggctgcggaagcggaagtcattgatattttggaacatagcctgaaaacagcggtgggcttgattgtctttgacgaagacaagccagagtatgcaggctacatcaagtctaaaaaccagaaaatcgctcagaagatttacattaagaagtcacctctggtattgaccggaacggaaatcctcaaagttgacattgaagcctatccaaacaagaaacgggaccactttgttgcgaccattcgggacgtggtggggcataaggatgatgtagggatcgatgtcttggaagttttggaatccatggatatcgtgtcggaattccctgacgaagttttggcggaggccaatcgggtaccagaaagtccgtctgagaaggactttgaaggacgcttggacctgcgagatgagatcatctttactatcgacggtgcagatgccaaggacttggatgatgcggtccatatcaagcagctcaagaatggcaatctggaactgggtgtccatatcgctgatgtcagctactatgtgactgagggctcagccttggaccaggaagctgtcaagcggggaacctctgtctatgtgaccgaccgtgtggtgccaatgctgccagaacgtttgtcaaacggcatttgttccctcaatccaaatgtggatcgcctgacccagtcggctattatggaaattgactgcaagggcaaggtggtcaagcactggattggccaaacggttatcaaaaccaccttccgtatgacctattccgatgtcaatgacatgattgcaggtaacaaggaaaagctggacaaatacaagacaatcgtgccaagtgttgagctcatggtcaaactccatgaaaccctggaaaccatgcgctacaagcgtggggctctcaactttgatacagctgaagctaaaatcatcgtcaacaaggatggtctgccagtcgatattcaactgcgccagcgaggcattgccgagcggatgattgagtccttcatgctagctgccaacgagtgcgttgccgagcattttgctaagttggacttgccttttatctatcggatccacgaggagcctaaatcagacaagttgcagaagttcatcgactatgcgactagctttggtctgacggtatatggtacagccagctctatcagccaggacgcccttcaggatctcatggagcgggtcaaggatgaaccctatgcggacgtcctcaacatgatgttgctacgttccatgcaacaggcgcgttactcagagcacaaccacggccattacggactgggtgcggagttctacacccacttcaccagtcctatccgccgttatcccgacctgctggttcaccgtatggtgcgggaatatggtcacaatccttcggaaaaagcagagcattttgagcaggtcattcctgagcttgccaagtcttcatccagtctagaacgccgtgccatcgatgcagagcgggaagttgaagctatgaagaaggcagaattcatgcaagaatttgttgggcaagagtttgatggtgtcgtatctagcgtagtcaagtttggtctctttgttgagttgccaaacaccgttgaaggactgatccatgttaccaacctcaacgagtactaccagttccacgagcgaactctgaccttgcagggtgagaaatcaggtcgtgtcttccgtgtcggtcagccaatccgtatcaagctaacgcgggcggacaagatgacaggggaaatcgattttgcccacatgccgtccgaactggatattgtcgaaaaagctttgaaagccaagcggagaactgctagtcactccaaccgtgaccgtgatgatcggtcagggcgaggacggggcaagcactacaaacaagaagctgctggtcgcgacagcggacgtcacaagtctggaaaagaccacaagtcaaaaagtggcaaaaaagacaagaaaaagaaaccattttacaaagaagtggctaaaaagaacaagaagaaaaggagataggcatggccaagggtgagggcaatgtgattgcgcaaaataaaaaagcccgccacgactataccattgtcgatacagtggaggcggggatggtcctgacggggacggagattaagtctattcgtgcggggcggatcaaccttaaggacggctttgcccagatcaagcagggcgaggcttggttggtcaatgtccatatcgctccctacgatgagggcaatatctggaatcaggagccaacacggacccgcaagctcctcttgcggaagaagcaaatcgagtctttggacaatgaggtcaagggaacagggatgactctggtgcccctcaaggtctatatcaaggatggctttgccaaggttttgattgggcttgccaaagggaagcacgactacgacaagcgggagtcaattaaacgccgtgagcaagaccgtgatatcaaacgaaccatgaaggctatcaatagtcgatagaggctgggagaaatcccggtcttttttgttataggaaaacaaataccccagacagtttcgagactatctggggcttattatttatcttaatccaccgtaatcatagctttaatcgttttccggttggccatgtctttgtaggcttggtcgatattgtccaggctgtaagtttgggtgaaaactcgacctgggttgatgtcgcctttgagaacagcatcaagcaaaatttccttatcataggttgtgacagaagcagagccaccatcgataatgatattttgagcaaaagttgatccgagggcgtggttgttgtaatgaggcacaccaacaaaaccgatgcgaccgccattatgaaggacgccgagggcttggtcaatagaagcttctgttccgacacattcgagggcagcatcagcgccacctccaagaatttcacggactttggcaattccttcctcgccccgttcagcaacaacagcagtagcccctgattccagagccatttgctgacggtcagcatgacggctcatcatgataatctgcgaagctccccgcatttttgcagcaatgacggcacattgccccactgcaccatcaccgatgacaaccaccttatcaccaggtttgacatctgcaacacgcgtagcatggtagcctgttggcataacatctgccagagtcaagagagatttgatcatgccttctgagtagtcgcttggctgaccaggaattttgaccaaggcccagttaccgtagtggaaacgaatatattgagactggtagttgttgccccagttggtgtagcctggatggttgtcacaagtaccgtcaaagccagcacgacaggcatcacagtgtccgcaaccatgtgtaaatggaacgataacgaagtcaccaggaacaagtgttgtaatgtcttcgcctacctcttcaacgataccgatggcttcatgaccagagtttgtgtcaccgtggtcatggtgaatgtcttctccgtagccccaaaggtccgacccacagacacaggcccgaacgaccttgataatgacgtcatctttggcttgaaggcttggtttttcgatttctgcaacggtcatcttaccggctttttcataaatagctgctttcatattttctacacacctacatttattaataaatgtcctttctgattgatatggaatattatacaccttggagttcactctaagtcaagtgaaaatatagatttgaaatcaagatttctttgtgatagactagaaacacgttttaagttttgtagacgaaaaggagagataatgactgttttagttccttacaaacgcatgcctatttggaatcaggatacggttccccagcattttttgaccaagcacaataccaaggtaggtacttgggccaaaatcaaggtcttgagaggtcaacttaaatttgagccgatttcagatgataatgaaattttgggagaatttgtctatggtccgacagatgatgttccctttgtcgagccacaggcttggcatcgggtgactttgctgacagaggatacggagtttttcttggaatttttctgtcaaccagaagactattttgccaaaaagtatgactatactcggacacattcggaagtcttggaggccttgaagagaattgagccttgtaaggtcttggacttgggctgtggtcatggcaggaacagtctctacttggcccagcaggggtttgaggtaactgctgtagataaagatgtaccaagtattcggacactcttgcaggtcaaggaagtagaagatttggacttgcaggctgggacttacgatattaactcagctagtctggagcaggattacgactggattatctcaaccgttgtctttatgttcttggagcgggagcgggtgccagctattatccgcaatatgcaggagcagacacgacctggtggctataacttgattgtggcggccatggatacagaagatgcgccctgtcctatgaatttctcctttacttttggagtaggtgagttgaaggaatactaccgtgactgggaactggtcaagtacaatgaagatttcggtcaacttcacaagcgggatgaaaatggccatttcctcaagatgcggtttgcgaccatgctggctaggaaaaaaggataaatatttttttgaaagcacttgcaaggcaggtgcttttgcgttacaatgtaggtgcaaatgggtaaatcatattatactccacgaaaatcaccttctggttggataagagacttgtgtaaaatagtctctgagtttatatctctggagggcgcctacttctgattttcacagagtatcaggaaaggagaagtctatgaaaaagacttttgttcgtatagccacatttctaatgttggtttgcctattccctgttcaacttgttcaagcctgttcaggctttattattgggaaagggttgacaacggatggttctatcctttatggtagaacggaagattatccatatccaccaaataatggagcgcacaataaaaattatattgtggttccagcaacagcctatgccaagggggatatgttggtggatgaatcattcggtttcacagcaccacacttggcaaatgagttcaagtacacctctacgcctgatgcggcacgtggggatgggtcaaacggtaattttggtgcgcatggatttaatgaaaaaggtgtgtccatgactgctactgttacagctattccaaataaaaaagttttagctgttgacccattggtaactgcggggggactaggtgaggccattttgattgactatgttcttcctagagtcaccagtgcgcgtgaaggtatcgaattaattgcgaagacaattgatgaaaaaggttcggcagaagggaatatcattgttattgctgataagaatgaagtttggtacatggaaattttgtcaggtcaccaatacgtagccatcaaattcccagaagacaagtatgcaatttttgcaaatacttactatctaggtcatgttgattttaccgatacagaaaatgtgattgcttctgcaaaggttgaagaagtagccaaacaggctgaaaattatatgatggttgatgggaagttccatattgccaaatcatatggacctgagaattatgctgatggtgatcgttctcggacatacgctggtataaaattgttagatccagcatcgtctgtaacctatgaagatgctgtgtatgatttgctacgtcagccaacagacccaagtcgtcgctttagtttacaagatacctttgccttacaacgtaaccgttttgaacatcttccagaatttcgtccagacgatgaagcaggtaaggtaaaacaaggggataatggtgcgaatgaccaagcggcagatgcgacttataaatacgctcttggtaatgaaaacgtcatcgatgcccatgtttatcagattaatagtagcttaccatcagccttcggtggcacagtatggttgggcttggctcagacaaggaatacaccgtatgttccattttatggtattgtgactgatacttatgaagcctttaaaaatcgctcagcttcttatgataccaattcatggtactggacggtacaaaatattgataagatggccatctcacacccagagttatttggtacatcaattcaagaaaaatggattgcacttgaaaaagaatggattgcttcacaggcagctcttgatgctcaatatgccggactttcagaagatgcagccgtagctctggctccaactgtaacagaggcaaccttggctcgttcagcagagatttttgcccaactaaaagctgttgaagctgaaatgatggcaaaaattgaagcagcaacaactccgtcatcaagtagtactgaaccatcgaccagcactgagccatcatcaagtggtaccgaaacttcaaccagtacaagtcagtctacaagtgattctaacacaggaggagctacggatacttcctcatcaagccgaacagtagtgccttctgataagaaagtaacacctaccaataaaaaaggtaaatcaagtcttcctagtacaggtgagcaagtcagcctcttgttggtggcgctaggtgttgcaggaattttaacagcaatttttcttcatcgaaaaaaatccagtaaagaataaatagagctagtaagaaataggttggggtctctccaatctattttttatactcaatgaaaatcaaaaacagacttgctccaaaggtttggggaacctttggaggttggagatagagcgaacctagttcgtatcgatatgatgtagatagaacactgttccttttatatttcaagggaacaggctgaaaacctccacaggagcttttcagtcatcaaatcaagtcaacaacgtctgattttgattttcgaagagtattaatcaaaaatgtttacaaacgtagtcgtatattgtataatttgtttacagatgtagtcggaaaaggagtaacctatgaaacaagcaagctatcccattcaaggtatgacctgcgcttcctgtgctctgacggttgagaaagcggttggtaaactagcaggaatggaagaagtcagtgtcaacctagcgactgaaaaattgagtgtcagctatgatgaaaagcttttgggactagaggatattcgtcaggcagttgaaaaggcggggtaccagctagtcgataacttggtgaccgagtcttatgacatttcaggcatgacctgtgcttcctgtgctctgacggttgaaaaagctctgggcaaactagagggtgtagaagaagtcagtgtcaatctagcaacagaaaaggcgactatccgttatagccgtcataggcaaaatccagctagtcttgaaagagcagttgagcaggcaggttatcagttgattagaccagaaaaagtagaaggggctgcggacaagggaccgagcacggaagaaaagctgaggcatcgatttgtctggtcagcagcatttacttttccactgctctatattgctatgggtcctatgttgccttggggagggcttccgttaccagctttgctccaccaaccgctagtctatgcgatcagccaagttatcttgctcatccctatcctctatatcggacgcagttttttccaaaaaggctttaaaactctcttgcaaggccatcccaatatggattccttgattgctgttgggacaggggcagccttggttcaaggtcttttgatgattgtgtttcttcagatggggaaagaagtggccatgcacggtcaccatccagaactgtattttgaatcagccgccgttatcttgacattgattaccctaggaaaatattttgaagctagagccaaaggtcagacttctgaggcgattaagaaattgatggatctggcccccaaggcggctcaggtcttgcgaaatggtcaggaaatgcaagtgccgattgaagaagtggtggtcggtgaccaggttattgttcgtcctgggcaacagattcctgttgatggtcaggttctcgaaggccagacacgtgtggatgagtctatgctgacgggtgagagcctaccagtgaagaaagctctaggcaataatgtttttggcggcacccttaaccagcaaggcgccattaccatgcaggctaccaaggttggtcgtgatacgactctggcccagattattcgcttggtagaagaggctcaaggttctaaggcccccatcgccaaattggctgaccaagtatctgcaatatttgtaccagtcgtcatgggcttggctctcttgtcgggtctggcctggtacttcttgggtcaagaatcatggattttttcactaagtattatcatcgccgtcttggtcatcgcctgcccttgtgctctgggcttagcaacgccgactgccatcatggttggtactggaaaaggtgcagaaaatggccttctgttcaagtctggtcaagctattgaaaccctacaaggtgtgaataccattgtctttgacaagactgggaccattactgagggcaaaccccaggtgacagacatccacctcttgtctactaaaaatcgtgagcaagttctccagctagcagcaagtagcgaacaattttccgaacatcccttggctcaggctctcctgcaagcagctcagacagaaaagattgaactcttgcccgccacagattttcaggcactttctggtcgtggtctttcggtgataatagcagagcagaccatctatctgggaaatgaacggttgatgcgggaacagggaattgatgtttccaaaggacgtgcagttgcggaggcatttgcccagcaagccaagacgcctgttttcctagccagccagcaagaagtactagcagtcattgccattgctgataaaataaaagagaccagccgtcaggctgtccaggctctgcaaaccataggactagaggttgtcatgctgacaggagataatgaaaaaactgccaaagccattgccaaggaagtcggcattgaacaggtgatcagtcaggtcctaccagatgacaaggctaaccaagtcaagttcttacaagaacagggcaagacagtcgctatggtgggggatggcatcaacgatgccccagctctagctcaagcacatgtgggtctagccattggttcagggactgatattgccattgagtctgccgacattgtcctcatgcatagtgacattttggatgtggtcaaggctgtcaaactcagccaggcaaccatgcggaccatcaaacaaaatctcttctgggcctttgcttataatgtgataggtattccaatcgccatgggtctgttacatgcatttggtggacccctgctcaatcctatgtttgcaggtgcagccatggccctcagctcagtgtccgtcgtcttgaacgctctgcgattgaaaacctacaaactatatcaaaaataccagtcaaaaaactggtatttttttacataaacgcttacaatgtatatattaagtgcaagggagatgtttatgacaacctttattggaaaaccggtgaccttggtaggtccgcaattaagagtgggggatgtagcccctgattttgtcctcatggccaatgacttgagcttgaaaagcctgaaagactttggcaagcagaccaaggtcatcagtgttgtgccttctattgatacagggatttgtgatacccagacccgtcgcttcaatcaggaactggctgaccgtgacaatacggttgttattacggtttcagcagacctcccctttgcccaaaaacgctggtgtggcgctgcaggtttggaagatgccatcaccctgtctgattactatgaccatgcctttggtaaatcctacggtgtgctcatgcgggagtggaatttgctggcgcgtgcggtctttgtcctcaatgccgacaatgaaatcacctacgtagaatacttggataatgtcaacgaacatccagactatgatgcggctttggaggctgttaaataaagatataacggtgccggaacaggcatcgttttttgatggaatatttttgtctaatttgatatactaaatttatcaaaaacaaggagggtcttttatggaaaagacacagattattcaagacgttttggccctcattcaagacttgaatcgggcctttcaagcagataaagtaggaacagctgatgaacaacggttccaacataatctgacagagacgacacgcatattgtcggaggccaagtcggttaccaatacagaactgattgcgattgagaaattttatcgttcgaccagttttttggttggactgggcgacctgcgattgagtgaaaccagcaggcaggcttggcgggcatttgaccgatattactacgaaacgatcagagaagaactcaaactctatggcggctctgctattgcccaagtgtaaaagatgaaggagagggtgaaaaccctcttttgtgctataataagtagtaggaatacagtttttaggaagagaagaagcgaggtgtatcatgtcctatatccaagtaaagaattcgtcaaaatactaccaaatgggagatgcgaccattgtggccaatgatggtgtgtcctttgagattgagcagggtgagctggtcatcattctgggttcatctggtgcgggcaaatccactctgctcaatatcttaggtggcatggacagcaacgacgagggggaggtttggattgacggtgtggatatcgccaagctgtcaagtcatgaactgaccaattatcgtagagatgatgtaggttttgtatttcaattttataacttggttgccaatctgaccgccaaggaaaatgtggaactggcagcagaaatcgtcaaggatgccttggatgccgaggaggtcttggaacaggtcggactcggtcaccgaatcaataatttccctgctcagctttcaggcggtgaacaacaacgtgtggccattgcccgtgctgttgccaaaaagcctaaaattttgctttgcgatgaaccaactggcgctctggactaccaaacaggtaagcaggttttacaaatcctacaagatatgtcccgcaagcagggggcaacggtgattatcgtgacccacaatagttccctagcccctattgcagacagggtcattcggatgcgggatgcccgtgtgcactccgttgagttacacgcagaaccacaggatattgcaagcctagaatattagtgggtgaaactatgaaaaagaaaatctactggaaggatatgagacaatctctgctttcttccaaggggcgttttttgtccatatttagcctgatgatgctaggagctctagctttgacaggtctgaaagtaacagctcccaatatggaaaagacggcccaagcctacatagccagtcatcgaacgatggatttggcagtaatttcaggtctgggacttagtcaagctgaccttgacgaattagaaacgatagaaggtgctactcttgaagcgggctactttaaagatgtggttactaatgaaggtcagactgcaattcggctgttttcagctcccaagaccctatcgacctataaactagtagaaggggaagtgcccagccaaaaggggcaaatagccctatcagcttctttcaaaaatcgttacaaattggacgatactgttcaagtgacggagtctgataaggatggaaaaatcttgacacagacaagttttactcttgtgggctttgtcgcatcagcagaaatttgggacaatgaaaccatgggcatggctgtaagtggtgatgggcagttaggtggctatggccttgttagtcaggataccttcaaatcagaagtttacactattgcccgtattcgctatgatgatttggttgatttaccatattacagtcaggcctatcaagacaggttggaccagcaccaagaagacttagaaaagttattggctaacaatgatgaacaacgattggcaactattcagtcagatggacagacagatatttcaaaaggggaagaggaaattgctcaggctcagtcccagcttgaacaggcagagtcagaactggaaacaggggaggagcaattagcgacaggtcgcagtgagtttgcgcgtggtagggctaaggttgtccaaacggaagctgaattacgagctgcccaagcccaactattaaaaaataagtttgaattggaagaaagtaaaaaggaattggacgggcgtaaggctcaattagaacagactgcttcatttctagacggctatcagatggaattagaaatgtcagcccagcagttagaagaggccaagcaagaattggattcccaaaatgcccaactgagtcagaccgcatctcagatttccacagggcgagctagttggtttcaagctcagcaagagttagaccttgaaattgccaatcacttgcaagaaggtcaaaccctctcagactatcctgacttgttggccagacaggaaggtttggatgttgagaaaagccgattagaccaaatggaatctgcacatgagcaggccaaccaagcctatttacaaggttatgattactatcaaaccaaacaaaatgaatacaatagcaatctagcccagtaccaaacttggaatcaagaatatcaggcaggtttggcccgttatcaagcaggtttgagtcagtatgaacaaggcattgcagcctacaataaaggagtagaagactatgaatggggactgagtcagttagagtcttcaaatcaactgctccgtcaggaagaactccgtttggaggaggctgataaagagttaagtcaagctcaatcccaattttctgataagaaagctgtggccgatcaagaaattagccaagctcaaaccgagattgctcaggctaaatccgacttaagtaagctggcaaaagcgccctatcaggtctatactcgttcaagcctaccaggtggagatggctatactacctatagcaatgcgactaggtctattgctgcagtgggcaatgtcttcccagttgttctctaccttgtcgcagctctagtgacttttaccaccatggcccgttttgtcgatgaagagcgaacacagtcaggtatcctcaaggcccttggttatacgaatagacagattatggctaagttcattctctatggtttggcggcaggtctggtaggaacaatagtcggcataatagcaggtaatctcctcttgtctccacttatttccgacattattacgcagacaactgtgattggaccagctaaacttcatttttatcccctttggacaggtttagccttgctcctatctttggtttcctcggtcctgccagcttacttggtggctcgtcgggagctgacagaaaaacctgctcagctacttttacctaagccaccggtcacaggctccagcatttggcttgaaaaatggccggctatctggtctcgtctgagctttacccataaggtgacagcccgcaatatcttccgctacaagcttcgtatgcttatgaccatctttggagtagcagggaccgtcgcccttctttttggaggactgggtatccgttcctccatctcaggagttgtccaacgacagtttggggagctgatccattatgatatgttggtggtggaaaatagcagagctactgaggaagagttagataagttaacacattttcttcagtcagatcaggttcgccaatccttgccagtggcttttgaacagctcaatcaaacggtggaagaaaacggtcagagaaagaatttatcgattagtctctacatttcagaccgtcgggattttggaaatcaagtcagtctggaaagctcgacaggtcagcctattaaactgagtgacagggggattgtcctcacagaaaaattggcgcaaatttacggggtctcagttggtgataagttatcactgaccttggaagataaggaagtttcagtcagggtagaggctgtggctgatatgtacgcagggcattttatctacatgacagatagctactacgaacaagtgaccggcaagcagaagactgccaatgcctatttggttcaattgaaagacagtcagttggggcatattcagactcttgcaagtcaactcctagcgatgccagcagtcagaagtttggttcaaaatacttctcttatagacatgcttaccacgattgcaggctcgcttcagaccatcatgaccattctagtcatcctatccatcttgctcggcttggttattctttacaaccttacaattatcaatatgtccgaacggattcgtgaattatccaccatcaaggtgctgggcttccacaatagagaggtgaccatgtacatctatcgtgaaaccattgccctttcgctgattggtatgttggttggactggttggcggtatttatctccacaagctccttcttgccatgattggttcggacagtatccgcttcaatccatctgtcggactagaagtctatctcattcctatcttagccattagtggaattttgtctgttcttggttggtatgtcaatcaccatctgagaaaggttgatatgctggtggccttgaagtcggttgattaaaacagtctgggaatagactgttttaacccgagcctaaaaacacgaaagcggatagtctgtattgtgaactaatttgaaatatgagaaacacagctataaagcaaaaaaatcctagtgcatctaggatttttctgtaaacacaagtctagaagtgtgctataatcatctcatgaaaaaaataagtgatttaggattaacaggtcgaaaattagttggagaaggtctaatcttagtcttcatcggtattggatttttaattgctggttggcaatttccaggactgattcttcgatttgttcacgcaggtctattctttttagctttatatgaattgagcatgacatttttcagaaagaagaaatcaagtgaaagtgttattgcgctagttgggaaggctgttcttttcgggatcctagccagtctcgatttagctgttcaaattcccctctatttcgcggctatttttgttgggatttatcaactttttacagctcttatcaatttcattactttttacctatatcgaaaagatggggtacagccacggattcgctatttaatagatggaatttggttattcttactaggttcagcttccctatttgtgtcaggcacacagctggttgttcaaacaattgtcatcggaggttatctgatcttgtatggactaactaatctgcgtgatggtttcttgtttgaggaggcgattgagcaacaaaatcttaagcgccatgtccgtttgcctctacctttatttttagcagctttgattcctcgtatgaccctgcaaaaagtcaatgattacttggcggataatgagggacaaacggctcaatctatctataaccgccacaaagaaattgcggagcttccagcattagaagtctttgtgcatgtaggtgaagagggttttggggctgttggacatgttgatttgagctataagggacgagtgtatggttatggttcatacgatgtcctgtctgagcgtttgggtggtgcgattggtgatggagtcttgttcaaagcagagcgccaagcctatattgacttctgtaatcaagaaggaatgaccatgttaggttaccagctgagcttaagaccagagcaagaagaggcaatagaaactcgattggctgaaattgataatctgcttcttccttggaatccaagtcctgaaaaagtatcgaaaacggtagatgggcagccgattgaaatgtatgcctatcgaatgaaagaggcaatacatgcggaattattcaaatttagaaagtctaaatttaaaacctatttcgtcctatctactaattgcgttcttctggctgattctgtgattggacaagctggaaccgatatacttggtatgcatggatttatcgcacccggaacctaccaatcttatctggatcaagaatttgaaaagccacatagtttagtagtcgcaaagaacatttattatcgaaaagaaaaatcctagtcactgactgggattttctgttattccagctctctaagttccacaaaactcccccatccatgctataatagagacatgaaaaaaaataaattattattaatcgatggctcttctgtagccttccgtgccttctttgcactctataaccaaatcgaccgcttcaagaatgccaacggtctgcataccaacgccatttacggcttcaatctcatgctggaccacatgatgaagcggattgagccgacccacattcttgtggcttttgatgctggaaagaccactttccgtacggagatgtatgcagactataaggcaggtcgtgccaagactccagacgaattccgtgagcagtttccttttatccgtcagatgttggatgccatgggagtcaagcattacgaactggatcagtatgaggcagacgatattatcggtaccttggacaaaatggcagagcggacagacatccctttcgatgtgaccattgttagcggtgataaggatttgatccagctgactgatgagaacaccgtagtcgaaatttccaagaaaggcgttgccgaattcgaagaatttaccccagcctacctcatggaaaaaatggggattagccctactcagtttattgacctcaaggctttgatgggagataagtccgataacattcctggcgtgaccaaaatcggtgaaaaaacaggtctaaaactcctgacagaatttggttctttggatggtatctacgaaaacattgacagcatgaaggcttctaagatgaaagaaaacctgattgctgataaggagaaggccttcctatctcgtacacttgctaccattgatactcaggcaccaatcgaaattggtctggatgacattgtttatcaaggccccaaggtggatgaactgggacaattttatgatgacatgggcttcaaacaattaagggctcagttaggtacgaccagctcgcaagaggaagcggtgctcgatttccaaatcgtaacggaaatcagccccgctatgctcaaacaagaccagtttttctattttgaaatcttgggtgaaaattatcaccgagaggatttggttggtttagcttggggagataaggagaaaatctatgtcggagggcctgagctacttgatagtccagtcttgcgtgactttttagaaagccaaaccataaaaacctatgactttaagcgtggaaaagttcttctcgaccgaaaagagattaagctacctccagctactttcgatagccgtctagccaaatacttgctttccaccgttgaggacaattccctaacaaccattgccaacctctatggtcagaccagtcttgttccagatgaggcagtttatggcaagggtgctaagttagacttgccagaacgcgagatctttttcccacacttggcacgtaaggttcaggttttgattgagacagaagagccgatgttgaccaaattagaagaaaatcagcaattagatcttttgtttgacatggagttgccactagcaaatgttttagctaagatggaaattgctggtattaaagtggaagctgagactctcaaagctatgcaatctgaaaacgaagttttgattgaccagttgaccaaggaaatctatgaactagctggtcaggaatttaatatcaattcgcctaagcagcttgggaccattctctttgaagatatgggactaccattggaatataccaagaaaaccaagacaggctattcaacagcagtagatgtcttagaacgattagcgccaattgcaccagttgtttcaaaaatcttggaataccgtcagattaccaagcttcaatcaacttatgtagtcggcttgcaggatgccattttagaagatggtaagatccatacccgctatgtacaggatttgacacaaacaggtcgtctatcttcaacggaccctaacttgcaaaatattcctgttcgtctagaacaagggcgcttgattcgtaaggcatttgtgccatcgcttgaaaatagtgtccttttggcatcggactattcacagattgaattgcgcgtcttggctcatatttctcaggaccagcatttgattgaggccttccagcaaggtgcagatattcacacttcgacagctatgcgggtcttcggtatcgaaaaagctgagtatgtgacaccaaatgaccgtcggaatgccaaggctgtaaacttcggtgtcgtctatggtatttcagatttcggtttatctaataacttggggattacacgtaaggaagctaaagcctatatcgatacctattttgaacgcttcccaggaattaagaattacatggaaaccattgttcgtgaggcacgtgataaggggtatgtagagacgatttacaaacgccgtcgtgaattaccagatataaactctcgcaatttcaatgtccgtaattttgcggaacgaacagccatcaactcaccaattcaaggttcggccgcagatattctcaaagtagccatgattaatctcgacaaggctttgactgaagcaggtcttgcgacacgtatgttattgcaagtacacgatgagattgttttggaagtcccagtggcagagctagaaacggtaaaagccatggtaaaagagactatggaatcggcgattagcctgtctgtaccattgattgcggatgaaaatgaaggttcaacatggtatgaagcaaagtaagaaaggaaaaagtatgaaaaaattaattctttgtattggtctatgtagtcttctacttgcaggttgcggaaaagcatcgcagaagactgagaaaacaccagcttcttcaggggaagagttttcaaccaccttaccgattttgcaagaaaaacaggatactacgaacgaacagttcaatgttttagcaaatgcagaggttgtagctgttaatagtacaccacctgccgacgaaacacaaaaaggccacaagatttatgcggccaataatggtgttgctgaaaaagatgaaaatgggaatatcaaggaatatttccgttattatgatgtgccatctacttggacaattaatgcagaaaatactaaggatgagacggtcgctgcagtctacgatgttaaagaggggggaagcaattacatggttcaaatctataatatcaatgcttttaatcagtctccattggaagacggtcgcaatatgacgccggaggaattagaagcacggatggttgaaacaaatcattctttcagtgaaaagacggttgtcacaatcaatggtcaggaatggcaggttgggcgacagttattaacagatcaaaaattagctcgtctgactttttatcggatggaatcaacagctgcttatgatgactccgtggttgtgggttcaatctattattccttagatccaggagatgataaaaagcgtaccaatcttaaaaaggttatcggccaagttaaggatgttgtgtaccaaattgctaaaaaataatcaaggtagacaagctataatcagtaacgagttaaaactgacaagattgtgttatagcacaccttattcattaagcttttattgattctaacatttaatatacattaaaggaggtctctatgtcttattccttccaaaatcctagtcaggacattatctttgactatctgaaaaatgctaagaccattgcagtggtcggtttgtctagtcgagaagagacggcagcctaccgcgtttccaagctcatgcaggaagcgggctataaaattattccagttaatcccaaggctgctggtgggactattttaggcgagttggtctatagtagtctagcagagattgaccaacctattgatattgtagatgttttccgcagaagtgaatttttaccagaggtagcacaggaatttatccagtcgaacgccaaagttttctgggctcaactcggtttagaaagccaagaagcagaaaaacaattgcgtcaggcaggtcgtaacgatattgtcatgaataaatgtatcaagattgaatatcttgaaatgaaagaacaatactaataagtcgggtatatttatccgacttttttcatcgaaaaagcagctcaatgaaccattgaactgccggatgactctaaggaggagcacttagaattggaataaattactacacatggcgtaaaaaatagaaaggaagaaatctgctccaataccaagcaggctaaaatagtcctttgtcgctcctcagtcatagtataacacaatccaaatgtttgtaccaattattactatattttttttcttaaatatagacataaaagcgtatataaaaataagagcaaatatcgctcttattttatacgtaactcattttcttagcctgatcatctaaaatttcttcatggaagtgcatttgtgcagcatagtgatacggccatacatataaaccagccaggccaaatgtaataatgacaagaaggaaccagccgatgaaggataaatcaagtgtaaagcgtttaaacttgtaacctttcatcaactttcgactagatttaatgattgaaaaggcacctgtatattcttcgcgttccaattgttcaaacaagatatattctacctgtgagtaagcatagatttgtggaatataaagagcaattcctaaaaccataagtaggatacctcccatggccattagccctagtatggcaaggatttccataggaagtgcatcagggtctaaggattgactggatgcagctataatcgtaatcatcgttccagcaccgataagtagaccgataccaaggtaaaacagtagtccccaaaggaagagcaagaaactttttaaaatgtaagttcgaaagattttccagaaatctttatgattgaaaatgctcaaggaatctttgaatgatgtggtagttttgccccctttgatgatattgaagatagtccatatgactgataatgacaacattcctagtagcaatccgtaaaatactggaaacaaagaggtagaaataaagtagctcggactagcaagttcctcagccgacactccagcaaggctattgcgagagaaagaaattaactgaacgataacagaaatagtgacggggatgacggccacttgatagataccaggtgtctcgtttagcgtttggcgagcccgctcacgtatattagaaattgtaaacatctacataacctccttacccaacattgtaacataattctagatgacaagctaggctttttttgatagactagaaggtgctgtgggaatttgtcagtttgttgtgatgcgcctatctatttactattaaataagtagaagaaaaggcaaatatcactgaaataagcgagaacattaaagacattctgatagattagaccatgcaagattgagaaactgtatttccaggtaaagtgcttttatggatggtatgaaagagctgaactgtgaatccagaactaatatcctaggactgtttttcctagcgggaggtaaataaaacatgacagatgttccaatcaagtatcgcttgattaagaaagaaaagcacacaggtgcacgtttgggcgaaatcattaccccacacgggacctttccaacccccatgtttatgccagttggaactcaggcaacggtaaaaaccatgtcgcctgaagaattgaaagcgatgggttcaggaattatcctatctaatacctatcatttgtggcttcgtccaggtgacgaattggtggcgcgtgcaggtggtttgcataaatttatgaattgggatcaaccgattttgactgactcaggtggtttccaggtttattctttggcggatagtcgcaatatctcagaagaaggtgtgaccttcaaaaaccatctcaatggtagtaaaatgttcttgtcacctgaaaaagctatctcaattcagaataatcttggttcggatattatgatgagctttgatgagtgtccgcagttctaccagccttatgactatgtaaaaaaatccatcgaaagaacaagtcgttgggcagaacgtggtctcaaggctcaccgccgtccgcatgaccaaggtttatttggtattgtccaaggtgctggttttgaagatcttcgtcgccaatcagcccatgatttggttagcatggattttccaggatactctattggaggattggctgttggtgaaacacatgatgaaatgaatgctgtactggacttcacgacccctcttttaccggagaataaaccacgctatctcatgggtgttggagcaccagatagcttgattgatggcgtaattcgtggggttgatatgtttgactgtgtattaccaacacgtattgcgcgtaatggaacctgtatgaccaatcgtggacgtcttgtagtgaaaaatgcccagttcgctgaggactttacaccgttagatccagagtgcgattgctacacatgtaaaaactatacacgtgcgtatctccgccatttacttaaggccgacgagacgtttggtattcgtttgacaagttatcacaacctctacttcttgattaatttgatgaaaaatgtccgtcaagcaatcatggatgacaaccttttggaattccgtcaagactttatggaaaaatacggttacggtaaaaacggcagaaatttctagaataaacaacctcctacagatttgtaggaggctattttttatccttcaaaatacagtaattcttttggtgtttttgtaaagacttcaaagccatttttggtaacgtaaccacaatcctcgatacgaacaccaacttttccagggatgtaaatacctggttcgacagagaaacacataccttcttcgatgaccaaatcattgccttccataatcgatgggaattcatggacactcattcccaaaccgtgaccgagtcggtggttgaagtactcgccataacctgctttttcaatcacagagcgagcggcatagtcaatctcgccagcagtcacaccaggcttaatcatattgacagctgccatgtgagcctccagagtcaagttgtaaatatcttttttaaactgatcgggtttaccgacagcgacagtccgtgtcatatcagacgtatagcccaaagcttccacgcctaggtcgaacaatagcagagcgttattctcgattttgtttgttgagggaataccatgtggatttgcggcattgtcacctgttaagaccatggtctcaaagctcatttttgagatgccttgctttttcatttcaaattcaatctgagcaataatatcagtttcagttacatcgagtgagatgttattgaaaccaacctgcatagccttatctgcaaactctccagcaaccagcattttttcaatttcatcacgagacttgatcaatttcatagtattaatcagaggtgtaatgtctgaaaatggttggctaaagatagactgaagaccatggtagcgggttaaattcaaattatcaaattctgcacagattgctgagaaagatttttgtggcaatttgctcttgataatctgccatggattttctgagtccatatagccggctacaggaaaatcaacagtcgcaaccgcacgctctacatccaaggcagggagaaagagtagtgagtcgtggtcaggcataacaaagagcatcatgtggcgttcatgaggatcactatgatagccagtcagataatagatgctaactggatcagagaagatggccaagtccattttgttggcttctaagtaggatttaacatgatgtaattttgacatagtggagacctttctagcatgtagtggtaaaaaaagtgaaattttcgtttattatatagactattgtttcaaaaaatgaaaaaaattgcaagtattatcaaaaaaatagagtttatctcttgaaagtggtttcaaaaagtgatacactatacttgagtgaaagcgtaattttcatagaaccagaactattgaaagggagtacataacgtatgttaaacactgacgatacggtaacgatttatgacgttgcccgcgaagcaggtgtatccatggcgacagtatcgcgcgtggtaaatgggaataaaaacgtaaaggaaaatactcgtaaaaaagtattagaagtcatcgaccgcttggattatcgtccgaatgctgttgcacgtggattggccagcaagaagactaccactgtgggggttgtgattccaaatattgctaatgcttattttgcaaccttggccaaaggtattgatgatattgccgatatgtacaaatacaatatcgtcctagcaaacagtgatgaaaatgatgagaaagaaatcaatgtggtaaataccctattctcaaaacaggtggacggaatcattttcatgggctatcatttgacagacaagattcgtgcggagttttcacgctcacgtacaccgattgttttagctggtaccgtggacttggagcaccaattacctagcgtcaatattgactacgctgccgctagtgttgatgcagtcaatctattagctaagaacaacaagaaaattgcctttgtatcagggccgcttgtagatgacatcaacggtaaagttcgttttgcaggctacaaacaaggcttgaaggacaacggaatcgagtttaacgaaggattggtttttgaatccaagtataaatacgaggaaggctacgctctagcagaacgtattttgaatgccggagcaactgcagcttatgttgcagaagatgagattgctgcaggtctattgaacggtgtcagtgatatgggcatcaaggttccggaagattttgaaatcatcacaagtgatgattccctagtgactaagtttacccgtccaaacctgacctctatcaatcagccactatatgatattggtgcaattgctatgcgcatgcttaccaaaatcatgcacaaggaagagttggaaaaccgtgaggtagttcttaaccacggaatcaaagtacgtaaatcaactaagtgataaatatgggagtagccggataagatatcttattactccgccccctcactctatcaaacattataatcatttagtttatcttttattactttgacgagcgaggaaatatttccaacctagaacggcctttaggctgttctagcaacctgtagctattgaggcaaacttgcttcgacttatctccagccttcaaaggttcggagaacctttgaagcgagtactaaaagcaaacgaaatggctatactaaccgaaaactaaaagattataaaaaataaatataaagccctcgctagatgtataagcttagcgagggctttgtggttgattttaagtctgtcacactctgtaagttgtgcgagatgttgaagcgaatctagagaagcagtactggacttgttctcatcctttagaactgtatcagttaggtgattattataatttacgtttacgtgtaaataacgcaattgcaagcccgataataccacttgtcaataaccataaacttcctttctcaccagttactggtaagatttgcttagcagtttcggttttaaatgttgaagtctcctgcttgtctgttttttcagttgttggtttagtgtttgaattttcttcgactgtaccattttggttgttctcattaacaggtatctgttttttagaggtttcgatattttccttctctttattagccatttgcttttcaggtgttacggcattgtccttctcattaacaggcatctgtttttcagaggtttcaaccttatcgttctctttattagccatttgttcttgaggtgttacgaccatgtcgttcacaatgcttggcatctgtttttcagagattacaaccttatcgttctctttattagccatttgttcttgaggtgttacgaccatgtcgttcacaatgcttggcatctgtttttcagagattacaaccttatcgttctctttattagccatttgttcttgaggtgttacgaccatgtcgttcacaatgcttggcatctgtttttcagagattacaaccttatcgttctctttattagccatttgttcttgaggtgttacgaccatgtcgttcacaatgcttggcatttgtttttcagaggtttcaatattatccttctctttattagtcatttgcttttcaggtgttacggcattttcgttcacaacactcggcatctgtttttcagaggtttcaatattatcgttctctttattagtcatttgcttttcaggtgttacggcattttcgttcacaacactcggcatttgtttttcagagattacaaccttatcgttctctttattagtcatttgcttttcaggtgttacgaccatgtcgttcacaatgcttggcatctgtttttcagaggcttcaatattatccttctcttcattagctatttgctctttagggggttcgatatttcccttctctttaccggtcattgcttccttagagacttcattatcagtaataacgctatccgtggttggcgctattaacttcccaggattcaaaatattctcgaagatttgatcgctattttcataagtcactgttgagactagttgtccgtgattgttatctttcacagtaacagtggccttaatatctgatttgtcatagataatatcgccaagtccaccatcaacttctgaaacagtgtaggtataggttccctcttttgtaaatgttagggcactaaagtttacagaaccatctgcttgattgcttaccttttcgatttcatcgcctttttcattttttaaaacaaattcgaattcaccggtgtttaaggtacgtccctcgaggactttttttatcgaaagactagcagcagctggagcaggtgtatagaaattgttaaagacattgtcattatcaataaattcgatcattgcctgtaattgcccgtttcgatcttctacagttatttttgctacaatatatttcgaatcatactcaataccaccaagctcatcttttacttctgaaattgtataccagtatttgccaggcttatcgaatgatagatttttaaatctaacttgaccctcttttgtattttgagctgtatcaaggacagggagttcctcgccattcgcttctctaagctcaaatttaaattcattttctagaagctcacgaccaaatagtcgtactactgctggtattttgacattaaccgcctttgaagtagcctgtcccccatcaggttgttttgcgctgatgatggtattttttacttcttgtgccgatacattattcactagagcaacagttccaaataatactattcctggtattaggagcgatgttctccatttcttagtattcattatccttttttcctttctcaaagcatgatttatgtagctaatctgtgtcgttataacatgcaaattttacatctaaagtcctcaataaaatttgaacacttagtgccagaatgtgcaccattcgtaaattataacatcttctaaaaaacattcaagctgtccttctgcttttaaaatctgttttatctgttttttatgtaatcatatatttgggattatattctttagtattggctttaattgatacaaaattcgtgtagaatacagtttaaaatatgaaaaaatgtaaaaaagggctataatggtattatgaaagtactattgtatttagaaggtaaaactgttttagagaaatcaggaattggccgggcacttcaacaccagatggaagcgctagatatggcaggcattccttatacaacagacctgctgggagattacgatgtcattcatatcaatacctatggtccacgctcctggttattgctacatgcagccaaacggagtggaaaaaaggtaatcatgcatggacattccacgaaggaagattttcaaaattcctttatcggttcgaataccctagctccttttgtagggaaatatctagcaagcatgtaccaaaaggcagactttgtcatcactccttcagagtattcaaaaaaactcatccagtcttacggtgtgacaacgccaattatagccgtttcgaatggtattgatttagataaatataagaaggatgaacgcaaggaagcaatctttcgagagcattttaaaattgaagaagggcagccggttgttgtctgtgcaggactctactttcgacgtaaaggaattgaagactttgtcaaggtagccgaaaagatgccgcatgtccgcttcatttggctcggttcaatcaataagtggctgattccgtcatatattagaaaaattgttgagggagatcatccagcgaatgtcgagtttccaggttattttaaaggtgctgtttttcaaggtgcaatgagcggagcgaatgcctttttcttcccatcgtatgaggaaacagaagggattgttgttctggaagctcttgctagtcatcagcatgttgttctaagagatattccagtttacgatggttggattgacgaaaacgttgccgaattgggacatacagtggatgattttgtcgattctattcagaaaatcttagacaagcaggttgataaacgtgaggcgggctaccaggttgcggttagtcgctcgattgacaatgtttcccaccaattggtggatgcctatcgacaagtattggagatgtaaatgcggattggattgtttacggatacctattttccacaggtttcaggagtcgcgacttcgattcggactcttaagacagagttggagaaattgggacatacggtatttatttttacgacgacagatgaggatgtgaatcgctacgaagattgggacattatccgaattcctagcgtacctttttttgcctttaaagatcgtcgagtggcctacgcaggttttacagatgccttaaaaattgcaagtcgctataaactagatattattcatactcatacagaattttctttggggattttggggaaaatgattgccaaggaactagatattccggtggtacatacttatcacacccagtatgaagactacgtacactatattgccaaggggaggattattcgtcccgggatggttaaatatttagtacgggcatttttaaaagatttggatggggtaatttgtcctagtgagatcgttgaagatcttttaatgagttacaatgttccgatttctaaacgagtaattccgacaggaattgacttggcaaagtttgatagaccagaaattggcaaggatgaaacagatgagttgcgggaacagctaggaattgctagtgatgaaacgatgttgttaagtctgtctaggatttctcacgagaagaatatccaagcaatcgttcaggcaatgccaaaaattttgctggaaaatccaaaggtgaagttggtcattgtcggaggtggaccttatacagatgatcttcaggaaatgatagcggagcttaatctagatgaacatgtccagttgacgggaatgattgcaccaagtgatacagcactttattataaagctgcggatttctttatttctgcttcgaccagtgaaacacagggactaactttcttagaaagtttagcttctggaactcctattttggcacatagcaatccctacttaaaaaacgttataacagataagatgtttgggacgctcttcattcgagaacaggagttggcagatgccgtcgttgaggcaattgttgctacaccaccaatgaatccgtatgtgcttgataagaagctctatgagatttcttctacgaattttggacgtaaggtttttgaatattatctagatttgaagatttcgtatgattttagaaaagaacatactaatcaagatagcgtagcagaagctttgataaaagaggctatttacctaccgcaaaaagtagtagttaaatcaacagacacgacagcaaaaatattgaaaaaatcagtcgaacaagtaaaatcaatccggaatttctttgaataatttggaggtttcaaatggaaaagcttcggaaagagagttggaagaatctggttttggcaactcttattattctgtccatgtatgcaggtatttatctgattgcctttcatctgattagtgatactatgctttctaaggaactggtggtcggaaatatattgctctatactcccattgtgctattcttaactggtcttctttatggattttttcacggtttttctcctagccttcttgtcttggttttactactttatcctgtaaccatctttttctttaaggaatggattattctctatcagattgtctacaccttatgtgctctgattggaaatgggataggagctctgctattttctctaagaaagaaaatgaggaaaaatccttgaaaaatcaggaaatcctgttataatagcttttagagacttatcaattctaggaaatctttgagagagtgtgcggtgggtgcaagcacatagaggataggattgacactactcggtatgattttatgcaaacataaaagggtggttcccttatcgccaatctgaggtagtcaggcttttttgcgtgactgcgaatgaaggtggaaccacgttacgacgtccttttacgagggcgtcgtattttcttttggaggaggaatgatgctacctgatgacttattaagacggtgtcaagatgtgcgtcgtgcttatagagagttggaaatcaagcaccatgacaaagagtggtctattgatgaggacctcttggctttgaccaatgatattggcaacatgaaccgactgattatgaccaagcagggtcgttactatgacgaaacgccttataccttggagcataaaatggctgaaaatatctggtggttgatcgaattagccgaccgcctggatattgatattcaaaaagaaatggaaacctttttagctcaaaaagaagagttattggggattaaaaataaataaaaaggagataaacatgattaaaattactttcccagatggtgctgttcgcgagtaccaggctggtgtgactacttttgaaattgcagagagcatcagcaagtctttggcaaaaaaggctcttgctggtaagttcaatggtaaattgattgacactactcgtgccattgacgaggacggcacgcttgaaattgtaatgcctgaccacgacgatgccttggacatcttgcgtcactcagcagctcatttgtttgcccaagcggctcgtcgccttttctcagacattaagttgggcgttggtccagccattcaggacggtttctactatgatacggacaatgcggctggtcagatttcaaatgaagatttgccacgcattcaggaagaaatgatgaagattgtcaaggaaaacttcccttctgaacgtcgtgaagtgactaaggaagaagctcttgaaatcttcaaaaacgatccttacaagttggaattgattcacgagcactctgatgacgagggcggtttgaccatctatacgcagggtgaatacgttgacctctgtcgtggtccacacgttccgtcaacgggtcgtatccagatttttgaattgctcaatgtggctggtgcttactggcgtggtaagagtgaaaatccaatgatgcaacgtgtttatggtacagcttggtttgacaagaaagacctcaaggcctaccttcaaatgcgtgaagaggctaaagagcgtgaccaccgtaaacttggtaaggaattggatctcttcatgatcagccaagaagttggtcaaggtttgccattctggttgccaaatggggcgactatccgtcgtaccttggagcgttacatcacagacaaggaattggcttctggttaccagcacgtttacacaccaccattggcttctgttgaactctataagacttcaggtcactgggagcattactcagaagatatgttcccaactatggacatgggcgacggtgaagagtttgttcttcgtccgatgaactgtccacaccacattcaagtttacaaaaaccatgtgcgttcttaccgtgagttgccagtgcgtatcgctgagcttggtatgatgcaccgctatgaaaaatctggtgcattgactggtttgcaacgggtacgtgagatgaccctcaacgacggtcatatctttgtgacacctgaacaaatccaagaagagttcaaaaaagctctccagttgattattgatgtgtacgcagatttcaacctcaacgactaccgtttccgcctgtcttatcgtgacccagaggacaaagagaagtactatgacaacgatgagatgtgggaaaatgcccagcggatgttgaaaggtgccatggatgaaatgggcgtggactactttgaagcagagggtgaagcagccttctacggtccgaaattggatattcaggtgaaaactgcccttggtaacgaggaaaccctgtcaaccattcagttggacttcctcttgccagaacgctttggcttgacctatatcggtgctgacggtgaggagcaccgcccagttatgattcaccgtggtgttatctcgactatggaacgtttcactgctatcttgattgaaacctacaagggtgccttcccaacttggttggctccaacacaagtgaccatgattccaatctctgtggaagctcacttggactacgcttggaaggttgccaaagaattgcaagaccgtggcgttcgagtacacgtggatgaacgcaacgagaagatgcaatacaagatccgtcagagccaaaccagcaagattccataccaactcatcgtgggtgacaaggaaatggaagacaatgctgtcaacgttcgtcgctacggaagtaaggcaacacaaactcagtctgtatcagaatttgtggaccatatcctagcagatattgcccgcaagtcacgtccagctgaagcagctgaataaataaagcaagaagtccgaaagggcttcttttttgacagcaaaaactcccaaccgattggctgggagaaatttcattctatactgctcgcccaagacttagccacataacgtgacaggcttgaaatagcaaagttgatactgaagtaaatcagggcaaccataatgtagagagcaaagacttgctccgcctcaaagtagcgtcccatgaggatttgactcgaaccgaagagttcttgcaaagcgataacggagtataggaaactggtatccttgataaccgtcacaatctgagagatgatggcgggcagcatcttgcgaatggcctgtggcatgatgatatagaccatgatttgcactggggtaaaaccctgtgacaaaccagcttcggtctggcccggtccgatggcgttgagaccaccacggataatctcggccatggctgccgtggtaaaaatagtaaaagcagtaataccagcaggcgttgacttcatttggaagactaagaagacggtgaaaatccacagcaagtttggtacattacgcacaaattcgatatagatggttgcaatccacttgaaaattggatttttcccattgcgcatgatggcgagaatcattccgaaaagaatggacaggattaccgaaatgcttgagatataaagggttaacttcaatccgctccacaagagttggaaggttgaaggtttgagtaattctaaaacataattcatcgttcaacctccttttagtgtgaaaaggctgacttattcttttcttcaatgcgacgtccccagcttgcgacggggaagcacatgatgaagtaaaggaaagcagcaccagcaaaggctgggatgtagttggcattcatggcagaccaagattttgtcataaacataatatcagctccagagataatggcaacagtagccgtattcttaattaagtttactacttggttggtcaaaggtggaagaatggtcggaatggcctgtggtaaaatgatgattcgcatggtttcagactgagtaaatccttgtgaaagtgcggcttcagtttgcccagtaggcacagcctcaatccctgcacgaatgacctctgcgatataagcaccgtgatagagtccgacgcagataacagctgtccagtagatggatggcatgagaacataatttgaaatcagtggaagtccataataaacaatcatgaactgaaccaaaagcggcgtgttctgatagtattcaacatagacacgtgcgatgatttttaaaactttatttttacttgaagagagactaccaaagacaattcctaaaaacatggccatgataaaggctccgacagaaatggctaaggtaaagagaaaaccttggaaaaagattggaaaatctttgaaataactgacccaattctcccaagcgtaaggactagttgttaaaactgtcatattgtttcacctttctattcgtcagtttctgtgactggtttgagaccattggcatcatagatgctttgtaggctaccatcggcagtccatttttctacgagactatttaagtagttgttaaggtctttgttagataatttagtaacaattccatagtcagaagctgagaagctaaagtccatgagttcagatttcgaactgatatacccagcaaggatagattggtctacagaaaatgcgtctgtacggtgagcacgtagcgagacagagagttctggataagaaccaagctctgcaaaattgacagtgataccgtatttgtctgctagttcagagatgagggtacgtgtaatggaaccctgagctacaccgattgtctttccatccaggtcggtgaatgtcttaattccactatccttattgaccaagaagccaacggcatctgtgtaataaggagttgtgaaattgtagagcaacttacgttcctcagtgatggtaaaagttgcgatgaccatatccacttgactgttatcaagaagtggtcctcgggtttgcgctgtaacgggagtaaattcgatatctacacctaattcgtctgcaattttgcgagcaatatcaatctccattccctcgaattcaccagtatcagggttcttgtagccaaagtttgggacgtcctgtttcactccgacgcggagcacgcctctatcgatgatagcttgaacttgatcactattagtaatggatgcgggtgtttctgtttgagctactggttgttttgcgaaaacgagaagaataagtccaaagaccaataatctaattgcaaagaaaatgttgatttttttcttatccatagacttcctcctagagttttactttgtcagattcgtggttgataatcttactgaggaattgttgggcacgaggctctgtcggattgtcaaagaagccattcacatctgttgtatcaactaaaacttctccctcagccatgaagatgatgcgatcagctacttcacgggcaaagcccatttcgtgtgttacgacaatcatgttcatcccgtcacgtgccaatttttgcataactgcaagtacatctccgatagtttctgggtccaaggcagatgttggttcatcgaagagtagaagctcaggtttcatagctaagccgcgagcgatggcaacacgttgtttttggcctccggatagcatagcagggtaggaatccttccgatcccagaggttaacaaattcaagatacttttgagcggttttttcagctgtagccttattgattcccaaaaccttaatcggtgccaaggtaacattttctaacacggttttgtgtgggtaaaggttgaaatgctggaaaaccatgccaacttctttgcgaagtgatacgagctctttgatagaagtagaggaaatatcatgtccattgacgatgagcgttccttcatcaattgcctctaaaccgttaatcgtgcgaatgagagtagattttccggatccggaaggtccaaggagaacgacaacctgtccaggttcgaattccaagttgatattgcgtagggcgtggtagtcaccatagtatttattgacatctttaaattctactaaagccataaaattctccttgcatactgttttttaggtattcccatcttagcattgcctatatacaatgtcaagtaaattctgacaatttaatgtgttgtatgttataaaatgtgacatcaccgtgtcagatggttttgaaatatgaattttttaggtaagtctgatataatagaagaaataaagcaaaggtaagattctaatgaaaaaaatattaattgtagatgatgaaaaaccaatctcagatattattaagtttaatatgacgcgtgagggatatgaagttgtgacagctttcgatggacgtgaagccttggaagtatttgaggctgagtttcctgacattgtcattttggacttgatgttgccagaattggacggactagaggttgctcgaacgattcgtaagaccagcaatgttccaatcttgatgttatctgctaaagatagcgaatttgataaggttatcgggcttgaaataggggcggatgattatgtgaccaagcccttctctaatcgcgaattacaggcgcgtgttaaggctcttcttcgtcgtagtgaattggcagagacgcagacaaatattgagtcaacaggaactccagagttggtgattggcgatttggtcattctgcctgatgcgtttgttgctaagaagcatggtaaagagctggagctgacccatcgtgagtttgaattgctccaccatctggccaaacacttaggtcaggttatgactcgagaacatctattggaaacagtttggggttatgattactttggtgatgtccgcacggtggatgtaacgattcgtcgtctgcgtgagaaaattgaagatacaccaagcagaccagaatacattcttactcgtcgcggagtgggatattttataaaaggaaatgattaatcaattacgttatttaatgaccacggcagaattttggtttgttgtcattttgattggctttctaattgctctgacggtccttttgattgaaaactattgggataataagcaaattaaacaactcaatcaaaaagtcaatgccttaattgaggggaattatgcagatctgttagacatgaggggaagtcctgaaatcacagacatggctaattccctcaatgatttgtccgaggtcatccgcttaactcatgataatttagaacaagaaaagacacgtctgacgtccatcctgtcctatatgagtgacggtgttattgctacagaccgtatcggacggatcatcatgattaacgatatggcccagaaacagttggggttatctaacccaaagcaggagcagtatcacctgctagaggttttagatttatcagaccgttatacattgagagatttgttggctcagacacctgagattgtgattgatcacaccaatgaaaacgaagaatttctgactttacgcgctaattttgcaacgattcgtagtgagagtggtctgatttctggcctggttgtcgtcttgcatgatatgaccgagcaggccaaggaagaacgggaacgtaggctgtttgtgtcaaatgtgagtcatgaattgcgtacgccattgacttccgttaaatcctatctagaggctctggatgagggagcgctgacggagtctgtggcgccgagttttgttaaggtatccttagatgagaccaaccgcatgatgcggatgattacagatctccttagcttatcgcgcattgataatcaagttggtcagatagatgtcgaactgataaactttactgcttttgtgacctttattcttaaccgttttgaccaaatgaaaaatgctgattcagataaggtctatacgattgttcgtgactatcaaatcagtcctatttgggttgagattgatacagataagatgactcaggttttagataatatcttaaataatgccattaaatattcgccagacggcgggacaattaccttcagcatgaagaccacagatagccagttgattgtatccgtatcagacgaaggtctggggattccgaaagcagatttacctagaatttttgaccgattttatcgcgtagacaaggcacgatctcgtgcccaaggtggtacaggtcttggtttagctattgcaaaagaaatcgtaaaacaacataagggctttatctgggctaaaagcgaatatggtcatggctcaacgtttacaattgtcttgccgtatagcaaggacatcgcactagatgagtgggatgattcagatgaggaagaataggagaatatgatcggaaaaggttttaattatagtattttagcttcggggtccagcgggaattgtttttacctagaaacagataaaaagaaaatcttagtggatgctggcttatcagggaaaaagattaccagtcttttggcggaaattgatcgaaagcctgaggatattgatgctatcctggtaacgcatgaacatagcgatcacatccatggtatcggtgttttagcacgtaagtatggcatggacatttatgccaatgaattgacctggcaggctatggagagcaaattgggcaagattgatgtggctcaaaaacatatcttcgaattgggtgctatgaagacttttggcgacctagatattgagtcatttggagttagccatgatgctgcatgcccgcaattttaccgttttatgaaggatgacaaatcctttgttatgttgacggatacaggctatgtcagtgaccgcatggttggaattgtagaaaatgccgatgcttatttgattgaatcgaaccatgatattgaaattttgcgcgcaggttcatattcatggaatttgaagcaacggattttgtcagataagggccatctttgtaatgaagatggagctgacgccatgattcgctcgttgggaaatcggaccaaaaagatttacctagggcatttgtcaaaggaaaacaatatcaaggaattggctcacatgaccatggttaatcagttggcgcaggctgatttaggagttggagtggatttccaagtctatgacacatcgccagatacagcgactcccttgaccaagatttgacaattgatacaaactaagttatactgaaattactaattatacgaggtgaagttacatgaataattaagctacttattagttgctcttaaaacttgtggtgaggttacattaactgactatacaagggataagactgctcataagggcttactattcgtgtgacttttcccatagggaatggtcatgttttgcatggcttttttctgtgtccattttgcagaattggggccctttttgtgaagaaaagaggtctatatggaagtaataaaatgtattcgattagagaaggaatttgcgggacgtagaggctgggcaaaaagcttaacctcgcttctcagggttcgtgtcaacatctcagcgcagtggttgattggcagatttgttcgtgcttcacactccaaatctgacctaatcaactgtgcgggggcgggaagacgaactctttttatcttggtcgagttctttcctgctcccaagcagttgagccttcaagctagctggtcaaaaggttggtttggttggaaataacggagttggcaagtctacttttttgaaaatcttactaggactggatagggattttgccggtcagattgaggtaaaagcagactgggcctatgtaccccagttacaggaaaggagctcgctttcaggtggggaacaggtttggaagtctattcaagaggcttttgcccaaagaccacagttgttaatcatggatgaaccgactgccaatctggatcaagaacaccaggaaaagctaatcaaacaaatcaaacgctatcgaggtagtctactagttgttagtcatgatcggcattttctcaatcaaatagccagtcacatttggcatttagaagaagaaaaggttcaggtttatctaggaaattacgaggcgtttgtagaaagtcgccgggctaggcgagaaggacagcaggagtcttatgaagcctatcagaaaaaagttgcccaaatgaaaaaagcccaacatgaacgtcaagccaaggctcagaagatggggaagagagggagtgggatagaagtcaaccaattataaaaacttcgtcatcccacccccgcacagttgattaggtcagatttggagtgtaagaaacgaacaaatctgccaatcaaccactgcgctgagatgttgacgcgaactttgagaagtgaatgtggacatttattctaaatatcgtctgagtggaaagtcagtgccatgatggggtcctatgatagtcaagccaagtctatggccaagactgccaagcatttggaaaaacggatagagcgtttggacaaggttgaacaacctagaaaggaaacgtgggtaaagatggaagcgaaaggtgccttggatacgggtcttcacagtctctttcgcttgcaggctggtcaagttttgatggatgaagtgtatctatttgatgtccctcagatagggatgacgtttggagagaagttagccttagtgggggcgaatggttctggaaagactagttttgtccgaaaattatttaggaaagaattagcaggctattataatcctaagttaaaaattgcttattttgcacaggatttgataaaccttgatgaagaaaagactgcttttgaaaatgttagttgtacctctcttcaagataggatgatgattctcaatttattaggtatgttaggactttcttgcgataaggctcagcagaaggtagcaaatctgtctggtggtgagcgtgttcgtctctccttagctaaggtattgttggcggatgcaaatcttttgatactagatgaaccgacaaattttctagatatggcagctattgaggttttggaaacattcttgaaagaatatgaaggaagtgtccccttgatttcccatgatcaacagtttgtggaaacatctgttcacagtcaatgggagatagtgcaagcttgtctcgtgaagaaatcacaagaaaatattttctgaaaaggaggctctgtctaaaaaatattttttgcctgtggtataataagaaggatatttctagaatgaggtctttgaagtgaaaaaaagaaagaacaagcctttggaacatgatggaaattttatttcccttcgtttaaatattttattttctatcgtgattttccttttcctagttttgatattgcgtctggcagatatgcagatcatcaatcatgatttttatagtaataagctgtctactgccagtcagaaaatcatcagcaatggctctattcgcgggcagatttacgatgcgcagggaaaacctttggttgaaaacgagattcagcaggtcgtctccttcacacgtcccaacaagatgtctgctcaggaaatgaaagaagtagctaataaactcttgcagtgggtcaatgtttcagacgtaacaattactcaacgtgataaggctgattattatttggcagatgaagaggtttatcgtcaggtagtcgaggccttgccaaaagataaaaaatacgattccgatggtaactacttgagcgaatcaacaatttattctaatgcagttgatagtatccctgccgaagcattacaatattctgagcaagacaataaagcgattgaactcttcaagcagatgaatggagctacttacttctctactgttaatttggtaacggatactctgacttctgaacaggttgctcatatcgtagccaatgaaagtcaacttccaggcatttcaacgaccaataactggcaacggacgattttaccaacttccctcagctccattatcggtacagtaacgagtgaacaggctggtttgcctgcagaagatgcagaatactatctatccaagggctactcttcaaatgaccgtgtgggaactgcctacctcgagaaacaatatgaagaagtcttgcaaggtcaacgtgagaaaaaacaaataaacctagatagaaatggaaatatcgaaagtattgagacaatccaagaaggacagcagggaaataatattaaactgactattgatttagcctttcaagatggggtcaatgctattttgagaaaatactttgaaagtgagctagctactggtagtgcgctttactcggaaggtgtttatgcagttgcattaaatccttctacaggtgcagtacttgctatgtcaggatatagtcatgaaaaaggctcaagtactattacggaggatgctcttggtacgattacaagtgtctttacaccaggttccatcgtcaaaggagcgacaatcagctctggttgggaaaatggagttatcagtggtaatcagattcaattagatgaaccaatctattttgcaggttcagcaccaattacatcttggtatggggcctatggtagttttaatattgatgcgacagaggctctggaatattcttctaacatctatatggttaagattgctttgggactactcggtcagacctactcagctaacatgtatttgaatgatggtgatacattgaaaaacgccatgactaagcttcgttcgacttttgcagaatatggtcttggtgcttctacaggtattgaccttccactcgaatctacaggatttttaccagataagtatacgacagccaactttattaccaacgcttttggacagtttgataactatacaccgatgcagatggcacagtatgcagcgaccattgcgaataacgggacacggatttctccacacctcgttgagggaatttatgggaataatgcccaaggtggtttgggggaattaattgaaaccgtatctggtaaggagatgaatcaggttaatatttccgctgaggatatgtctcttcttcgtcaaggtttctaccaagttgtcaatggtagtgggcgctttaatacaggtagtgctatcggtcgtggtgcggccgtgaccatcagtgccaagactggtacagccgaaacctacacaacgacagcttctggtgatgtggttactgcggtcaataccaacgttgttgcttatgcgcctagtgataatcctcaaattgcggtagcagttgtcctaccaaacttgaccaatcaaagttcaacaactactaagacaattactcaagaaattatcaatctatatcaatcacttcacccaatgaattaaggaggcttatgctttaccctacacctattgccaagttaattgatagctattctaaattgccaggtatcggtataaaaacggctacccgtttagctttttatactattggcatggaggatgatgtcgttaatgagtttgcaaaaaatttattggcagccaagcgagacctatcttattgctccatttgtggtaatttgacagatcaggacccctgtgccatttgccaggactcaacgcgagaccagtctactattttgattgtagaggatagtcgagatgttacagccttggaaaatatccaagagtatcacggtctctaccatgtattgcatggcttgatttcccctatgaacgggattgggccagacgatattaacctgaaaactctgctgacccgcttgatggaaaatgaggtgacagaggtgattgtggcgactaatgcaacagcagatggagaggctacatccatgtatatctcacgtgtccttaaacctgctggaatcaaagtaactagactagctcgtggcttagcggtaggcagtgatattgaatatgcagatgaagtgaccctgttgagggctattgaaaaccgcacagagctatagcagttctgtagttagatacgttcctaattttgagataggatagctatgatttgttaaattatgctatactaagagtaatagcgttgatacaggaaggaaaatatatgtcaaaagaaaccttgattttactatatggtgggcgttctgcagagcgtgaggtatctgttctgtctgccgaaagcgtcatgcgtgctatcaattatgataaattttttgtcaaaacctatttcattagccagaccggggactttattaagacgcaagagttttctcaaacaccgtctgccgatgaaaaactcatgacaaacgcgacgattgttgaagagcaaaaaatccgtccgagcgatatttatgaagaaaaggcggttgttttccctgttcttcatggcccaatgggagaagacggatctattcaaggcttcttggaagtgcttcgtatgccttatgttggcactaatatcttgtcttcaagcgttgctatggacaaaatcactaccaagcgcgtacttgaatcagcaggaatctcccaggtaccttatgtggcagttatcgagggtgaaaatatcgacgataagattgcagagattgaaggaaaattgacttatccggtctttgtaaaaccagctaatatggggtcaagtgtcggtatctcaaaagctgaggatttagctggcttgcgtaaggcacttgatctggccttcaagtatgatagccgtgtcctcgttgagcagggtgttaatgcgcgtgagattgaggtcggtcttttgggaaatgctgacgtgaaaacgacacttcctggcgaagtagtcaaagacgttgctttttatgactacgatgccaaatacatcgacaacaaaatcaccatggaaatcccagctaagattgatgagtctatcatggatatcatgcgtgataatgctgccaaggccttccgtgctatcggtggttgtggactttctcgctgtgatttcttcctgactgaagacggcgacatcttcctaaacgaactcaataccatgccaggtttcacccaatggtctatgtatccactcctttgggataatatgggcctagcttatccagacttgattgaagagcttgttcgtttggctaaggaaatgtttgaaaaacgcgaaagtcacctcatttaattattatcaagattggaatcattccaatcttttgtcttgcaaaggtttgcaaaaagaaataaaatggaacaagttctggaggtgtttatgtatcaaacgacagtaaaaggggaaggtctgtttcaggctctttctcaaggatatggcgaatcggttcgtacctttggggtaacggagaagggtgagactccggttagtctagttaatattggcttagctgcctgtatcaccatgtgtgtgcagggctactatgccagccaagaaggcaataaaaccatgcctgttcaggtggagagtcgcttggacaatcagcgttttgaggtgttgattggaattggtgagtcggtttcagcgcagaagcagaaagagattcttgcctatgtggaaaagaaatgtaaagtcaaagctcttttgagggaagacttgcagtttgagacaagtttttatgtcttagaaagtgtggagtaagatgtttttagcaattgaagaaatgcgacaaggtttatgagatgaaagatggtgtcctcactcaagttcgataaaaagtggtataatagaaagagcgaaagctcttttttagtttattggagaaaacaatgaaattaaccctacacgaagtcgctcaggtcttgggcgcaaaaaatgatattagtctttataccgatactgcattcaacaaggtcgagttcgatagtcgactcgtcacaactggcgacctctttgttccccttaaaggtgcgcgtgacggtcatgactttattcctgtggcttttgaaaatggctgcgtagtaaccctgtctgaagttagccttgatgttcctcacattctagtagaggactgcttggctgcgcttcaacaattagcggcttactacctagagaaaacaggggtagaagtcattgctgtgacaggatcaaacggtaaaacgaccaccaaggacatgattcacgatgttctggcgacgacttacaagacttataagacacaaggcaactacaacaacgaaatcggtctgccatacaccgtcctccacatgcctgatgatacagaaaaactggtcttggaaatgggccaagaccacttgggagatattcatcttctatccgaaattgccaaaccaagtctatcagttattaccctttttggtgaagcgcatttagaatttttcggctcacgagaagagattgccaaaggaaaattacagattgcagatggaatggagccaggtagtaaactcttgatcccagcagatccgattgcggataagctcttgccgagccatgtagacctcattcgcttcggtgagcaggctgatttgcaggtgaccagtctggtcgagtcaaaagatagcctgaccttcaccgtcaattttatggacggcgacattttcctcccagtaacgggtaagtacaatgccaccaatgccatggtagcaagctacgtaggtaagaccttgggtgtgcctgatgaggcaatcaagtcagccctagccagtctaaacttgacccgaaaccgcaccgagtggaagaaggcagcaaacggagcagatattctcagcgatgtctacaacgccaacccaacggccatgcgattgattttggaaactttcactagcattcctgcaaacgaaggcggcaagaaaatcgccgttttagcagatatgaaagaactggggagccagtccgtcgatctccacaatcagatgattttgagcctgtcgcctgatgtgctagacaccgtcattttctacggtcaggatattgaaggtctggcccagttggctagtcagatgttcccgattggaaaagtctatttctttaggaaaaatgcagagcaggatcaatttgaagatctggttaaacaggttagggaaagtctaggaaaagaggaccaaatcctctttaaaggctctaattccatgaatcttgggaaagtagtggaagcaatagaaaagtagagaggagagacctctcttttttagcaagtcttgtcaaaacatcgaaaagttgatatactaacttttgaggaaagagaggattttaataagatgagtgatttttttagcaatcagatttctgaagcaccgaacctgaacgtattggaacatctgtttctcatgattatttggtttttcatgctccatctttgttttcgttgttatcaaaaaagatggtttcatattgttttttggtggcttcaatttatacagattgtctccctttatacttggtatatcgtagctgattctcctctttcagagagtcttcctttttatcattgtcgcttggccatgctctttattctttgggcgaagcccggacctttgaaacgttattttgcctatctcggtctttttggatcgcttgcggcctttattcatccagtatttgacccatttgcatttccacatctgaccttctttacttttgttattggtcactacgccttgacggttaattgtatgttgtacctgttatctgatttagaaggggagatgttgaagggaaaagaggtagtgaaatatacgcttattatgaatatgctgattctaggagtagctcttttaactggtggaaattatggatttttgagacaggcacctttagtgaatactaataatcttcctttgaatttcttcttggtaacctgcctactctgtttctctattttgagtatacaagctatgctgattgcctatttgaaaaaagaaagcaaacaaatgaattcgcatatattgaaaaaataagacttgaaattagtttttcaagtcttatttttagtttttaaatgcgccttgtttgtagctaatccagaaaaagacagggataaaaatgagcattaatccagaatagattggcaatgtgtgactgtttagggggtggatttcaatcagaccatgtaggaaatgggagctgatgaagaaaccgaaaacggaataaataataagagccagtcgagcttttgtcagtggcaaacaggcacgaatgacagccagtagacctgttgaaccaagaacataataagaaagggtttgcatgtcatgcaagtttaagtatccaaatacttgcattaaatggaaaataaggacactgagaacaaccatgagagcatttggtagggctaagagaagagattttctgagaaaatgtttttctacagggcggatatttcgttcaaaagttaggataaaaggaggaaaaccttcgacaaattgaccaatgagggtcatttgtacttgaataaatgggaaaactaacaaatattctgctttacctagggcaatactagcgctacagataaggccaagtaagaaagagtagattgttttgataagaaagatgggagcaatgtgggagatgttattaacaacgcgtcgtccctcaaagagaatctcaggaatatcgcgaaattcagaatctaggaggactagattagcgatttgtctggtagcgggatcgccttctgccataacaatggaacaatcagcttcgcgtagtgcaagaatatcattgaccccatcaccggtcattgcagtagtatgtccctgtgctttgagggtttggatgagcaattttttctgatgtggggatacgcgaccgaaaatggcggttgtttcagctctggcaattagttcttcgtcgtcaactttggaacaatcgatatagctatcgtagtcagcaaatccagcttccctggcaatgtgtgagactgtcacaggattgtcaccagagattatttttagtgtcacttcttgcgagcgaagataggccagtgtttctgcggcgtcttctcggattgggtcggcaatttctaatagagctagaggttcaatattctcaggtagctgattttgagaagaaagaagggactgttggctaagcgcaagaatcaggacacgggaaccacgagcctgtgcctcagaaacagaaggaggattttgtgttagtaacatttctggtgcccctagaaaaatgtgaccaatgttttctattgtcattgccccccattttctatcactagaaaatgggatgatgtgactagctttatagtggtgctctaaatcaccatattcttttcgaatggcctgagctgttgaattagtatcctcacttgtctggatataggtagcgagtatctgttggatagtgtcaagtgaataatggttggttaaggggagcaggttttcgacggtcattttcccctgagtaatcgttccggtcttatccaaacaaagaacatcaactcgggcaagtgtttcgacggaatacatttcttgtacgaggacatttttcattcccagtttgataacggcagttaagagagaagtgatggtcagcagagcaattccctttggtaacatacctagtagggcagtagagctggtaataactgagtcttttaagggaagaattttgatgaaaaaggcttctagaaaaagagcaagtccgaatggaatgataatttttcctgtaaatttagcaattttatccatattgtaaagaatacgagagacgataggtttgtgagttttcgcctcaagcatgagcttattggcatagttttctgcgccaacatggatgacttttgcataaatctgtccgctaactagatagctaccagacaataattcagccccagtatttttcacaatcaagtcgctttcaccggttaacatggcctcgtttgtctcggctataccttctaaaacaatagcatcactaggaacttgttcgccagcagacagcaagagaacatcatctaagacaatatcttctggtgcaatagatattgtctcgctatcgcgaacaactcggataaaatccttgttcatcaggttgagtttgtcaatcattcgtcgtgctcgccattctgtcagcattcctgaaacagcgttgaggacaataactccgaagaagaaaaggttggaccatgcctgaacagctagtaaggctaagaaaatggcaaaatttagtgcgttaaaagatgtaaacacatttcgtctgaagatttcccaattactggcactggtctttgtcttaaaatgattggtttgctggttttgaatacgttcttgtacttccttggttgataaaccttttatttgtttgttcattattttatctttctttttctagtatatagaatacatctcatacttattgtaacatatttataatacaatagtataggtctgtagacctattcttcaatagtttgaaaaattcccttatttccgatataataagagagttgtctagtaaagaataaggatgaatccaatgtaaatcgaataggataagagctcagctctgctatgaatcaaaatacaaaaaatgaaaaggaaacattatgtcactacaagaagaaatcaagaaacgccgcacctttgcgattatctctcacccggacgcgggtaaaaccaccattaccgagcagttgctctactttgggggtgagattcgtgaagcaggtacggtcaaggggaaaaagactggtaactttgccaaatctgactggatggatattgagaagcaacgtggtatctctgttacctcatctgtcatgcagtttgactatgcaggcaagcgggtcaatatcctagatacaccagggcacgaggacttctcagaagacacttatcggaccttgatggcggtggatgcggctgtcatggtggtggactctgccaagggtatcgaggcccagaccaaaaagctctttgaggttgttaagcaccgcaacattcctgttttcacttttatcaacaagttggaccgtgacggtcgtgagccacttgatttgttgcaggagttggaagaagtcttgggcattgccagctatccaatgaactggccgattggtatggggaaatccttcgagggactctatgacctccataacaaacgtttagaactctatcgaggtgatgagcgttttgcaagcttggacgagggtgacaagctctttggttctaaccccttttatgcacaagttctggatgatattgaacttctggcggaagctgggaatgaattttcagaacaggcgattttggacggcgatttgacacctgttttcttcggctcagccctgacaaactttggtgtgcagaccttccttgacaccttcttggaatttgctccagagccacatggtcacaagacaacgacaggggatgtcattgacccgctcaataaagatttttcaggctttgtcttcaaaatccaagccaacatggaccctcgtcaccgcgaccgtatcgcctttgtccgtgtggtttcgggcgaatttgaacgcggtatggcggttaacctgcctcgtacaggtaagggagccaagttgtccaacgtgacgcagttcatggccgagtcccgtgagaatgtggaaaatgcagtagcgggtgacattatcggggtttacgatacagggacttatcaggtaggagataccttgaccgtaggcaagaacaagtttgaattcgagccgctaccgaccttcacccctgaaattttcatgaaagtttctgccaaaaatgtcatgaaacaaaaatccttccacaagggaattgagcaactggtgcaagaaggagctatccagctctacaagaactaccagacaggcgagtatatgctgggtgccgttggtcagctccagtttgaagttttcaaacaccgcatggaaggcgagtacaatgccgaagtagtcatggctccaatgggtaaaaagacagtccgctggatcaagccagaagacctggatgaacgcatgtcatcaagtcgtaacattctagctaaagaccgctttgaccaaccagttttcctttttgaaaacgacttcgccctccgctggttcgcggacaagtatccggatgtggagttggaagagaagatgtagcggaaagacagaaatcagtaatcaacaaagttgatttgatttcgtcgtctttccctcgcaagggcggcgtccaaagaactcgagcaatgcgaagagtgatttgttgtgacgcctactgcgtcgaggttcagtgaactttttctagtggtagatgagagctgatggtaatcagcttaccttgataaagataactataaaaggatatgatagaatacatgaagctgggcaagacatctatgatgtcttgcccagcttcatttttaggctctttgtcaactgtagtgggtagatgaaaagctaacacctagagaggacgaacttcgttctctctttctttatgttcaaagcaatcaaaatgcgttttttaaagttctcaaagttcctgaaaccaaaggcatttctcttaatgactttgatgagattattagtagcttccagtttggcgttggaataaggcaattctagggcattcaaaaccttgtctttatcctttagaaatgtcttaaataccgtctggaaaataggattaacagtggctatttccagttcgacgatgtcaaagaaatggtctgagttcttctcttggaaatggaataagagcaattgatagagttcatagtgctgtcgtagttcctcggagaaagacaggagtttttccagtatttccttgttagtcaaatgcattcgaaacatagggggataaaatcgtttatcgctgagtttacgactatcctgttgaatcaatttccagtagcgtttcaaggctcggtattcctgcgaggttctgtcgaattgattcataatttgaatacgaacacggttcatagcacggccaaggtgttgcacaatatgaaagcggtcgagtacgatttttgcattcggaaaaagctgtttagcaagttgataatagggactaaacatatccatggtaatcactttgacctgatttctaacctttctaggatagcgtagaaagtggtttcggatggttgcttgagttcttccgtcgagaatggcgatgacgtttagggagtcgaaatcttgagcgatgaagctcattttccccttcttgaaggcatactcgtcccaactcatcacttcaggtagggtattccaatccgtttcaaacttgaactcattgagctttctcataactgatgatgttgagatagatagcctgtgtgcaatatgtgtcattgcttgattttcgatgagtaattgagcgatcttctgactaacagcgacggagatttgatggtttttcttaacaagaggagtttcagcgcccgccattttcccacattctttacacttgaaacgacgctttttaaggcggataaggagtggataaccagcagtttctaggtaagggatttttgatgctttctggtagtcgtacttagccatttgtcccttgcattctggacatttaggagccatgtaatccaagtaaccgtggagttctaagtgagttcccatatcatattcatcagtgatagtgatatttttgtctttaattctgagaaaatttgtgataagatttagttgttccatatgagtctttctaatgtgagtgtggttgcttttcattataggtcatatgggactttttttctatactcaaaaaggctccataatctccacggtggttttacccactacagaaattatagaacccatttttaaaaggtgtaatctttcagaatttcaatagactcaatttttacatctgttttaggtttatcgctattgtctgtttcgactgaagcgattttatccacgatgtccatcccttcaatgacttgaccaaatacggtatgcttgccatctaagtttggattgcctccgtttttataagcgtcaatgattttaccaggatagctagaactagagagttggctagacatgtctgttgtattttgattgatgaaaaactgacttccatttgttcccgcgccagcgtttgccatagaaagtgagccacgaatgttatagaggaaagctgaaatctcgtctttaaaaccatttccagcatcgatagtagtatcttttccggcccagatagactctccaccagtaccatttccaagaggatcgccaccttgaatcatgaaatccttaatgacacgatggaagatcgttccattatagtatccttccttcgcatgagtcagaaagttttccacagttagtggtgcttgctcggggaagagttttatagtgatgtcgccttcggttgtttttattttaatagcagcctcattttcaccaatttcattggaaagttgggggaatgtagctttgggattgttaatggcgtatgccaaatctttggcatattggctagaagcagttgtatcagctgtcgtagtcgagcttggactagaactagatgctgtagaagatgagctattagctgtcgagttgtttgtgcaggcagttagcaagatgctcgaagctagagcaagaactagtatttttttcattgaaaatcctttcttgtcttgttcaaaattatgctcattctaccatgaaatatggattttttcaatttttatctagtataaaaagcgtatctaaaacaataatatgatatactatatttaaagatgtaaaaggagaataatgatgtttgagaacttgtttgacccagatggaagcctagtatggcatacggcccttttctacagtttttccgcaatcatattagcgacagtttgtttccatatcattaaaaattttatggaatggcaccacaacaatcgggcgcccaaagaatcttgcaaggctaagcttgtctctaaacgaacccatgtttttggtaacgaagtagcacgaaccaattattatgtaacgtttgaatgggagggaaaacggcaggaatttcgccttcgttcagatgaatatgcccttttagcagagagagatgtaggcaccctgcattttcaggggactcgtttcctaggttttgaacggctctaagagtcgtttttctttggagaatatccctatctagtgtataatggtttgaacacatgttcgtacaacgcaaaagaggtatttaagatgattcaatcaatcggacaagttatgttatatgtgaatgatattgaggcttcagctcaattttggaaagagaaaatgggatttgaacgtgtagaaaaacaagtgcaagcccccaaacttcttacattattgcacctaaatcagatagtgaggtacaatttgtacttcatgataaggcggaggttgctgagatggagccagaattaaacttaggtacaccatcaatcttaatgacatcagtagatgtagccaaaacttacgaagaacttgttgaacgtggtgtcacaacgaatccagtcatggaccttggtttcatgaaggtaattagctttgcagacaatgatggaaattattacgcaattcgtgaggtaaagtaaatgtcactccagaatcgtgttgaagaaatgtataaagaccacgaggtcaaaccctatatttcccccgagcgtgacttggcagcctggctgttggaggccaagcccgttcccaaacgcaatatggttcgtctggaagaaggtattttgccaggagatattattttgctatggcggattagcctgggttcttttgaatcgacgacgccctactccaagtactttgagtacatgtatggtatcaatggtcctgctcacatggagcagttgatcgcagacggttatgcctatgtggaatcggcctttgattccctagaccacatcacttctactgccaagaaaaatatcctcaaagcagagggtgtgacaggcctatccaagatgaaggcggcagacctcgacactgccctcaaggacaacttgacggaagaaaagttagctccatactttaccgtccgaggttatgccctgacggaaaaaggcagagctgcactcgataatcacccagaagtgcttgcaaaacacccaatgaagaagatgtacaaataaaatagaaaagatttttaaacggcactcaaaagttagaatcattctagctttttgggtgtttttatttgctaacaagtcaatttttcttgacagaaaacgctatcaatgatattctagtgtaaattattgaaacgtttcaaaagaaaggggtaaaccatggaagaacaaaaatcaattactatgaaagatgtagctcgagttgcaggggtcagtgttgggacagtttcaagagttatcaacaatgagccaggtattaaggaaagtacgcttgaaaaagtcaatgctgccattaaggaattgaattacattccagatgtttatgctcgtggcatgaagaagaacaaaaccgaaactatcgccttgattattccgacagtttggcatcctttttttggagaatttgcctatcatgttgaagtggaactgagtaagaaaaattacaagttgctcctttgcaatatttctggtccaaaaagggagttggattatctgactatgctgcaacaaaataaggtggacggcattattgctatcacctacagtccaatcgaggattacttatcttctaacattccattcgtcagtatcgaccgcacctatgaaaataaggctatcccttgtgtcagttcggacaaccgagctggtgcggaactggcagcgaataccttgatagcaaaaggaggtcgccattttgcctttatcggtgggcacaataaaacaatcaatgaaaccaagaagcgtagattgtattttgaaaagaggattttagaggcaggttttccttgtcatgtcttggacttggaagagccatatgatgactttgtcggtcaagtcgaagagtttctgattaacaatccacaggttgatgctattttcaccatcaatgattttacggccctagacacacttgctgttttggaaaaactgagacgacgggttccagaagatgtgcaggtgattggctatgatggtattcagttggcaagtgaaaaatctttagccctttcgaccattcgtcaacctttggagtctatggcccaagaagccgttgcctgtctaattgatattattgagaaaagagagcgccccctacaagtcactctaccgatttcctatcttgaaggaaaaactacaaaaaatttttaaaaaagcagttgacagaaaacggttacaattgtaaaataaaaccatcaataaacagttggttttattttcacaagaaaaatgaaacgtttcaaaaaggagttcttatgaaaacatcaaaactgcaacaagctagtctattcgatagaatcaagcaacagaaactcttgttactgatgttactaccaggcttggtcttgactttcatcttccgttacattcccatgtacggagtgctgattgcctttaaagactataatcctttaaaaggggtgcttggtagtgagtggattgggtttgaagagtttaccaagtttctctcgtctccaaatttcggcaccttacttgccaacaccttgaaattgagtgtctacggtctgctcttaggatttcttctaccaattattttggccatcatgctcaatcaactattgagcgataaggctaaaaaacggattcagttggtgctctacgctccaaactttatctcagtcgttgtcatcgtcggtatgattttcctcttcttctcagtaggaggaccggttaattccatcctaggtatgtttggcattgaagccaacttcctgacagacccagacttcttcagacccctctacatcctcagtggtatttggcagggaatgggctgggcatcgactctttacacggctaccttgatcaatgttgatccagccttgattgaagcggctaagctagacggtgcaaatattttccaacgaatctggcatattgacttaccagcactaaaaccagttatggtcattcagtttatcttagcagctgggggcatcatgaacgttggttacgaaaaagcctttctgatgcagacttccctcaacctgaccagttctgaaatcatttcaacctatgtctataaaatcggtttggtgtcaggggactactcttattcaacagcggttggcttatttaacgcacttatcaatattattctgctgattgcagtcaataagattgtcaaacgcatcaacgacggacaaggcttataggaggttcgtatgaatacacaaatgtacacaaaatttgacaagcgaatgctggttgtcaataaaatcttgctggcatttcttgttctcataacagttgtgcctatggtctatatcttagtagcgtccttcatggatccacaggccttacttagcaagggaattagctttgatccaaaggactggacagtagaaggttatcaacgggtattttcagacaagtctatcctacgcggatttttcaactccctcttttattccttctcctttgccttcgtgaccgtggctatttcagtcatgactgcctatccactctctaaaaaagatttggtcgggaaaaaatggatcaatgccttccttgtcttcactatgttcttcggtggtggacttgttccgacctatctcttggttaaagatttgggaatgttgaatactgtctgggccattattattcctggtgcagtcaatgtgtggaatatcatcttggcacggacctatttccaaggcttgccagatgagttggtagaagcggccgtaatggacggtgctaatgaatttcagattttctggaaaatcatgattccactagctaagccaattatgtttgtgctcttcctctatgcctttgtcggtcaatggaattcttactttgatgccatgatttacatcaaggacccagacttggagccactccaactagtacttcgtaaaatcctcattcaaagcgagcctgctaaggacatgattggtgcccaggctgccatgaatgaaatgaaacgaatcgcagaaatgattaagtatgcgaccattgtcatctctagcttgccactcattgtcatgtatccattcttccagaaatactttgacaaggggattatggctggttcactaaaaggttaaaattgttcaaaatttttatagaaaacaaaacaggaggttgtttctgatgaaacacacatttggaaaaacagttgttacacttcttgcaagtaccgttttattggctgcttgtggctcaaaaaatactgcttcaagccctgattatgaattgaaagatgttcaattccctttggaaaaatccgttacacttaagtttatgacagctagttcacctctagctccagccgattcaaatgaaaaattaattttcaagcgtttagaggaagaaactggcgttcatattgattggacaaactaccagtctgattttggtgaaaagcggaacttggacatcgcttcaggtgatttgccagacgccatccataatgacggggcttctgatgtggaattgatgaactgggctaaacaaggtgttattgtaccagttgaagacttgattgataagcatatgccaaacctcaagaaaattcttgatgaaaatccagagtaccgttccatgattacagcaccagacggtcatatctactcattcccatggattgaagaattaggagagggcaaggagtctatccataccgttaatgacattgcttggattaacaaggaatggttggacaaacttggacttgatatgccaaaaacaacagatgacttgattaaggttctcgaagcctttaaaacacaggatccaaatggaaacggtaaggctgatgaaattccgatgggcttcattaatggtggaggtaacgaggactttaaaattctatttggtgcctttggtgtaggcgataacgatgaccacttagttgtcaacaatgacggtaccgttgactttacagcagacaacgaagactacaaagaaggtgttgagttcatgcgtacccttcaagaaaaaggtcttctagattcggaagcgtttgaacaagattggaatacttacattgccaaaggtagtgaaaatctatacggtgtttacttcacttgggataaagctaacattacaggtatgaacgatacttatgacatcttgccagtcttggcaggtcctgatggaaccaagcacatcacacgtacaaacggtatgggcttccaacgcgaccgcatggttatcacctcagctaacaaaaacttggaattgactgctaaatggattgatgcccaatacaaaccaatccagtctgttcaaaacaactggggtacctatggtgatgaaacccaacaaaatatttttgaactcgacacagcaaccaatagtttgaaacacctaccattggagggtaccgcaccgggtgaacttcgtcagaagacagaagttggtggaccgttggctattcttgatgaatactacggaaccgtaacaaccatgccagacgatgctaaatggcgtttggacttgatgcacgcaacctatcttgactatgtaacaaacgatgatatttaccctcgcgtcttcatggaacaagaagatttggataagattgcccaagttgaagcagatatgaacgacttcatctaccgtaaacgtgcagaatggattgtaaacggcggtatcgaagaagaatgggatagctatttgaaagaattggaaagctatggtctttctgactggttagctatcaagcaaaaatactatgatcagtataaagaaaatcagtaatcaaaaggaggctgcctgtgaaaacagtagtagaagccaatcaatttattcagaaagaaaaaggaaacgttaatccgattttcaaaccacaagcccatttaacaccggaaacaggctggatgaacgaccccaatggatttatctacttccgtggagaataccatttgttctaccaattcaacccttacgagagtgtttggggaccgatgcactgggggcatgcgaaaagtaaggacttggtcaactgggaacaacttccagttgacctagctcctgataaagcttacgataaagacggctgtttctcgggctctgccattgtcaaagatgatgtcctctggctcatgtacacaggtcacatcgtcaatgaagacgggacagttagtcaagttcagaacatggccttctcgactgacggtattcactttgaaaaaatcgagcagaatccagtcgcaacagcagatggactgccagaagaagtgattgccaatgacttccgcgatccgaagatttttgagaaagatggtcactactactctgttgtcgcaaccaagcacaaggacaatgtcggctgtatcgtcttactcagctctcccaacctgacggattggaaatttgagtctatcttcttgaaaggtgaggccaaccaaggctttgtctgggaatgtcctgactactttgaagtggacggtcaagagtacctgattatctctccaatgcgttaccaaaaagacgggaatgactttatcaatatcaactccaatatctttgtgacgggtcatgtggactgggacaagaaagtctttgtggcagaatccttcaaggaaatcgaccatgggcatgatttctatgcagctcaaacgactgaaggtccagaaggggaacgtgtcatgattgcctggatgcatacatggggacgtccgcttgtaaccaatgacctaggccataagtggtatggtcaaatgaccctgcctcgtctacttaagcaaggtgagaatggactcaggcaggtcttgccagcaggtatcttgaacagctttgacgacattgaaatcggtcaagttattcaaggaccaagtaagctctccctcaaactggacgacagtctagacttgaaactgggtactgaccgagactatcttcaatttggctatgataaagccaaacaagaagtctatattgatcgtagtcacctcaaaatccagcaagttggtgaggaggaatggtcaactgttcgtcgagcggtcacggttcaagcgacagagctagaggtcttggttgacaccaactgtttggaaatctttattaacgatggtcaagaaaccttgacatcaaccttctacgtagaaggtcagattattctaaacgctctataatattatttgccctcttaaattattctttcactccaagagaaaccctgtatttgcagggttttttctatcatgaaaattcttcccgattatgataaaataaagagattgagaaagttgaggtatctatgagaaagacaagtaaaaaaggaaaggctacgaggcgaccaaccaaggcagaattagcacagcaagaacgtgttaaaaatatcacccttcgagtattggggcttttattcattgcctttgcagccagtcgcctaggtgtgtttggagtgaccagctacaatattttccggctattatttggtagtctggcctatctattattggtgggtgcatttatctaccttcttattcccaaagtcttacgcgaaagagaagggaccatatcgggcttctggctgattgttatcgggttattgattgaatttcaggcttacttagactggacctatcaagggagtgacttattcggtcatactctaaaattggccttgtcagacctagctaagtttcaggtaacagcatttctaggcggagggatgattggaagtatcttctatctgccagtctccttcctctttgcaaatgtcggttccttcttcatcggtcttctagtgatagcatttggtatcttttttgtaagcccatggtctgtttatgatgttgccgatggcttggcggttgccaaagataagttggtggagacgcaggtaaaaagagcagagcttcgaacacagaaaaaagcagaacgagaagaaaaacgtcagcaagaattagctcgtctagaagaggaacgccttcgtctagaggaagaggaagagtcagctcgggctttggcactggtagatagacatgtcaatttagaaacgggtgaaatcctcgaagaagagcctgttcaagtaccgattatttcagaatatgaccacttagacatagaagatgaatttcctattatgttggcagaagatgaccaaccagcacaatcaaactcggcaagccaggattctgaaacaaatgagtttgagaaggacgagacagatgtgcagattgatttcaagcctaagcagagactagcatataaacttccgtccatagacttatttgctcctataaaagctaagagtcagtccaatgaaaaacgaattgttcgtcagaatattaaagttttagaagacacctttgccagttttggaatcaaggtagtagttgagcgagctgagattggaccatcggtaaccaagtatgaagtcaaaccagcagtcggtgttcgtgtcaatcggatttctaacctagctgatgatttggctctagcccttgcggctaaagatgtccgtattgaagctcctatcccaggaaaatcactggtcggtattgaagttccaaactccgaagtggctacagtacctttccgtgagctctgggaacaatctaaaacagacccagacaaacttctggaaattcctctcggtaaggctgtcaatggttccgtccgttcctttaacctagcacgtatgccccatctattggtggctggttcaactggttcagggaagtctgttgctgtcaacggtatcatctcttcaattctcatgaaagctggtccagatcaagttaagttcatgatgattgaccccaaaatggtcgaattatcggtctataatgatattccccacctattgattcccgttgtgaccaacccacgcaaggctgctcgagctcttcaaaaagtagtggatgaaatggagaaacgctatgagttgtttagccaaattggtgtccgaaacttagaaggttataatgcgaaggtcgaagaatttaatagccgttcagaagaaaaacagattccacttcctctaattgtggtaatcgtagatgagttggcagacttgatgatggtagccagcaaggaagtggaagatgccattattcgcttgggacagaaggctcgtgcagcaggtatccacatgattcttgctacccagcgaccatctgttgatgttatttcaggtttgattaaagccaatgtaccatctcgtatcgcctttgccgtatcaagcggtacagacagtcggacgattctagatgaaaatggtgctgaaaaactcttgggccgcggtgacatgctctttaaaccgattgatgaaaaccatccagtccgcttgcaaggttcctttatatccgatgatgatgtagaagcaatagttggctttatcaaggatcaggcagatgcagattatgatgaatcctttgatccaggtgaagtggcagaaggtgatggcgatgcaggttttggtgatgctggaggagatccacttttcaacgaagcacgtgccttggtagttgagacacaaaaagccagcgcctctatgattcaacgacgcttgtctgttggttttaacagggcaacacgcctcatggaagagctagaagcagcgggtgtcattggtccagctgaaggaacaaaacctagaaaggtattggaaacacaataatgaaatttgatgcagttcatcatattgcaattatcggtagtgactatggcaaaacaagagaattttatgttgagaaactaggctttgaacaggtggatgaacatatccgaccagaaaaaaatgatattctcttcaatgtcaaaaaaggcaatctgatcttggaaattttcatcaaaccagatgcgccaatgcgtccggccatgcccaatcctgaacatacaggcctacgccatctagccttccaggttgcagatgtggaagcttgtctggaagagtttgaccgtttggacatccgacatgaagtcctgcgaacagatgattttgatggtaaaaaaatggccttcttctttgatccagatggcctccctctagaaattcatgaataagtccatcttttcatgcccagagaggcctatcaatatgacaactaattaatactcttagaaaatcaaaatcatacgctgttgacttgatttgatgaaggtcagttctatctatagtcatttgaattaactttgatacatcgtcactttcggcttgccgtactctgcagaagtgacttgctttgaaagttatatctccaacctagcacagccactaggctgtgctagcaacctgcacctcagttccttgtctgaaagctaattcattcgactatacatctacgtcgccttgtctgatttagtataaaaagaatccccactgcgcctgcaatggggatttattatgccatctatgaaaggatggatgattttaggattttaaagtgaagaccgcaataaccaaagctagatacatcaaaaaagtcaagataaaactagctcgccagaaaaccttgaagaaacgtcgatataaaaaattctttttctttaaaaggaagaaaccgcaaagaccaatcgctagtagtgagagggctaggacaagctgaggcagtagactgttatagtaggccttgtccgaaatcagataaaattcaattgcatagagaggaaaggcaatgtctgcaaagttccatcctcggttttgcaacctaaaaaacttgacagcaattatcgaaatggccaaggttagaaagatgaatagaaaggctactatttttaaaaatataatcgattcaaacatacattcattctataaaaaatgtgaaaaaaagtaaacctaaagcttgcatttctttgaaattcgtgtataatgaaaaggtatgtgtaaaacacatatttgtgggaggtaaaaatctttaattaccgccaaaaccacaataggaggattttatatcatggctaaaaaagtcgaaaaactcgtaaaacttcaaattcctgcaggtaaagctactccagctccaccagtcggaccagcacttggtcaagcaggtatcaacatcatgggattcacaaaagagtttaacgctcgtacagctgaccaagctggtatgatcatcccagtagttatctctgtgtatgaagataaatcattcactttcatcactaaaacaccaccagctgctgttcttttgaaaaaagctgcaggtgttgaaaaaggttcaggtacaccaaacaaaactaaagttgcaacagttactcgtgcacaagtacaagaaattgctgaaactaaaatgcctgacttgaacgctgcatctcttgaagctgcaatgcgtatgatcgaaggtactgctcgttctatgggattcactgttactgactaagtagcacccaagattatctgattacaaggagacatataacatggctaaaaaaagtaaaaacttgcgtgctgctcttgaaaaaatcgacagcacaaaactttacagcgtagaagaagctgttgctcttgcaaaagaaactaacttcgctaaatttgatgcgtcagttgaagttgcttacaacttgaacatcgacgtacgtaaagcagaccaacaaatccgtggtgcaatggtattgccaaacggtactggtaaaacttcacgcgttcttgttttcgcacgtggtgctaaagcagaagaagcaaaagctgctggtgcagactttgttggtgaagatgacctcgttgctaaaatcaacggtggttggttggacttcgacgttgttatcgcaactccagatatgatggctgttgttggacgtcttggtcgtgtacttggtccacgtaacttgatgccaaaccctaaaactggtacagtaacaatggatgttgctaaagcagttgaagagtctaaaggtggtaaaatcacttaccgtgctgacaaagcaggtatcgtacaagctcttatcggtaaagtatcatttgacgctgacaaactcgttgaaaacttcaaagctttccacgatgtaatggctaaagctaaaccagctacagctaaaggtacttacatgacttcagtatctattacaacaacacaaggtgttggtatcaaagttgatcctaactcactttaatcaatagaaagattgtcttagggcaatctttttttcttgagattttcttgacaagcacttgatttcgatttatactatattcaatttacataaaaggagttatccgatgaaagtagcagagaaagaagagctttataaatacctttctgcagcctacaaccttccgcaggaagcattttcagaagccctgcgtgaaaaaatattggaggtggcaggtcagctggacaaggaggaaaatctctatatactggcaggacacttaagtcgctttatcaatgcagagttaacagctctgacttgccgagcgcctaaggaattggtgcaactagcccattaccttcaagaggttcaaaaccattatcgctatgctagtctttttccaggaaaggtaaaataggagaaaacatgacagaatatacaaaaccactcgtttggaagtgggaagatgaaaatgacaaccgatctggcaaccgtccaacagcaggcagtcgctttgagcaagacctaccaaggggagagaagtctttccaagtctattcattaggaacgccgaatggcattaaggttgctattatgttggaggagttgaaagagttaggtatttcggaagctgattatgacctatttctcatcaatatcggtcaaggagaccaatttggctccgattttgttgccatcaaccccaactccaaaataccagctatggtagattattccgagcaagaaccgatttcggtctttgaatcagccaatattctcctctacttggcagaaaagtttgaggccttcctgccaaaagcttgggcagagcggacagaggttcttaattggctcttctggcaaactggcgccgctccatttgttggtggaggatttggacatttcttccattacgctccgacagcgcaagaatatccgattaatcgctatacaatggaaactaagcgtcagctagatctcttggatcagctattggcgacaagagaatatatagctggaaatacctataccatcgcagatattgctatttggtcttggtatggtcgcttggtgcaaggagaactatatccaggttcggcagaatttttagatgttgattcttacaagcatctaaagacctgggtagataaaatagctcagctcccagctgtacaacgagggttgacagtgaaatatcattcaattgataattaattgacttgcccaccttatgggtgggtttttcttttactttggtatgataaaagtttataatgaaagagttagactttgtgaaaatccaaaaatagaaattaataattgagtttttcctgtcttatatttacatagaaagtaatagaaaaatgtccgaaaaagttgaaatgcagcagtccaaagaacaggcgacaatggccagaggcttggcttggttgactgctggaaatattcttagtcgcctgcttggtgttgcttatgttattccctggtatatttggttaggggaatatcgagctgaagccaatgccctctttagtatggggtatcaaatctatgccaacttcttattgatttcaacagctggtcttccgacagctattgctaaacaagtagctaaatacaatgtcttgggtaaagaagaggtgtcgctttacttggtcagagaattcttcaagctcatgttggtctttggggctgtctttgcaggggtcatgtatctaagtgctccgtggttggcagacgcatcggggtcgaaagaaaagttacttccagtcatgtatagtctagtcccgcctctctttatcttcccagccatgagtatcttgcgtggttttttccaaggtcggcacgatatgaagccctatgcgatcagccagcttgcagagcaactggtacgggttatctggatactggcagcaacatttatgattatgaagttgggtagcggtgactatcttgaagcggttgtccaatctacctttgcagcttttgtcgggatgattgctagtgttgggattttagtttatactttatggaagcaaggttaccttggtaagttgcttcatgctaagaaacaaaagatttctttggatacaggtcaacttattaaggaaactgttcgagatgcgattccaattatcattttaggtctaacgattcaattattgcagtttattgaccaagtcacgtttattcgtgttatggaaagaattacggattacagtaattcggaacttttggaactttattcatatatggctgccaatccaagtaagattacgatgatgattatcgggatttcacttagtttgggaagtgttgctattccattgattacagagaaatttgtcaagaaagatttgaaggcggcgtctcatttagtggcggataatctacaattactctttatattcactataccggcaattgttggaacagtcctgttagctgggccactttatacgattttttacggaccgtcagagcctatcgccattactctatttatttggaacttatttttaattttacctctgggactatattctgtcattagtgtggtcattcaagcgatatttgaaaatagaagagccatttattatttcttgattgggatgctagtgaaaatcgttttacaagtaccaatgatctatgtctttaaggtatatggtagctttatctcaacgatatttgggttgggaattatgctgtacctcttctataggcgaattgacaaggttctgcatattgatgaaagactagtgataaaagatattgcgaccattagttggatttctatcgtaatgggactcgttgtatgggggattgaatttgtcttgaatcttatccttccagcaaatggctatgtatctagctttatccacttggctgttgcaggtggagcaggtatgcttgtctttgtcatcttgacattgaagactcgtcagctagatcgtttaattggaagtcgggctcagagtttacggaggaaattgcgcctaggctagtttgttttaaagatctctattttctactattgaaaagctgggaaaaagaggcgttttagaatgtgagaaggaaagttcgttgaggattttcctttttttttggagatttcagtataaaaaaaacggtttttgtggtagaatagtagggataaaaaagaggagagagatgatgaaacctaaatacgaacgtattctaatcaaactatctggtgaagccttggctggtgaacgtggtgtcggtattgaccttaaaactgttcaggaaatggcaaaggaaattcaggaagtcgcagaatcaggtattcagattgcccttgttattggtggtggtaacctttggcgtggagcgcctgctgctgaagcgggtatggatcgagttcaagcagactatacaggcatgttggggactgttatgaatgctcttgtaatggctgattcccttaaacagcttggtgtggacacacgtgtgcagacagcgattgcgatgcagtcagttgcagagccttatattcgtggtcgtgctcttcgtcatcttgaaaaaggtcgcattgttatttttggagctggtattggttctccgtacttctcaacggatacgacagcggctcttcgtgctgcagaaattgaagcggatgcgattttgatggctaaaaatggtgtggatggcgtctacaatgctgatccgaagaaagatgctaatgcagttaaattcaatgaattgacccaccgtgaagtgattagtcgtggtttgaaaatcatggatgcgacagcatcaactctctcaatggacaatgatattgatttggtcgtgttcaatatgaatgaaccaggaaatattaaacgtgttgtcttcggtgagccaatcggtactaccgtttcaaattcttcagaagaaaaataaatcatatcgtcatttagtttttcttttattacttcgttaattcgccttgtctaacttcggttatgcctgtggctcgttacctagtactaaaagtaaactaaaagactgtaaaaaaatacaaagaaggaagtcttatgtctaaagaaattattgctaaagcgcaagagcgcatgaaccaatctcatcagagtttggcacgtgaattcagccacattcgtgctggccgtgccaatgctagtttgttggaccgtatttcagttgagtactacggttctccaacgccattgaaccagttggctggtattacagtgccagaagcgcgtgttctattgattactccgtttgataagtcaatcttgaaggatattgagcgtgctttgaacgcttcagatcttggtttgacaccgcaatctgacggtactgttatccgtttggttattcctgcccttacagaggaaactcgtaagaacttggcgaaggatgtgaaaaaagtcggtgaaaattcaaaagttgccatccgtaatatccgtcgtgatgccatggatgaagctaaaaaagctgaaaaagcaaaagaaatcacagaagacgagttgaagacgcttgaaaaagatattcaaaaagtaacagatgatgctatcaagacaattgataaaatgactgccgacaaagaaaaagaattgttggaagtttaatcaacacgtttttagactacaaaaatagatcatcactgggctgtctaacttccagtggtgaaccaataagaaatctaatggggggagttagacaagacttcccccactttttaatcagaaagaagaaaatcatgaatgatttattagcacagtatatcgttggtttagtgactgacgaaaacgatcagttttactttgtccaaaaagagggtagaacctttgctctttctaaggatgaaggcgaacatagtctaggtcaatctgttaaaggatttgcctataccgatatgaaacaaaaactccgtttgacaactaaggaagttggggcgagtcgtaccagctttggttggggaactgtcacagaggtacgtaaggatttgggtgtctttgtggatacaggtctaccagacaagcaagtggttgtttccttggacattttgcctgaaatcaaggaactctggccgaaaaaaggggatcggttgtacgtcaaattagacgtcgataagaaggaccgcatttgggctctgccagcttttcaagaagattttcagaaaatggctggacctgcttatgataatatgcaaaaccaaaatctgcgagcgattgtctatcgtttgaaaatgaatggtacttttgtttatttgccagacaacaacatgcttggttttatccacccaagtgaacgatttgcggaaccacgtctgggtcaggttttggaggctcgtgtcatcggctaccgtgcagttgatcggaccttgaacttgtctctcaagccacgttcatttgagatgctggaaaatgatgctcagatgatattgacttatctggaaagcaatggaggtttcatgaccttgaacgataagtctgctccggaagacatcaaggccacctttggtatttccaaagggcaattcaaaaaagctcttggtggtttgatgaaggctgggaaaattaaacaggattcttttggaacagagttggtctagggggcgtctatgctagtatatattgctggtagtggggcaatggggtgtcggtttggttatcaattgtctaagacaaatcatgaagtgattttgctggataattgggaagaacatatcgaagcgattcgagaaaacggcttgaaagtgactggagacgtagaggaaactgtatacttacccatcatgaaaccgaccgaagcaacgagagaagcagattttattattctactgacaaaggctgatcagttgccaaagatgttgcgggatattaaaccgattatcggtccaactaccaaggttttgagtctcttgaatggtttggggcatgcgacgaccatgcgtcggtacgtgccagatgaaagtattatggttggggtgaccatgtggttggcgggactaaagggtcctggacatgctcacttagaaggtccgggttctatgtccgttcagcatattcttggtgatgagcaatcagttgcggatattattgaaatgctgaatgaagctggactaaatgtgacctatgacaatcatgttgtcagtgctatttggcagaaagcctgtgtcaatggtgtgatgaatccaacttgtaccattttagactgtacaattggtgaattatttggtacggaggctggactaaatctagtacaggggattttcaaagaatttattgctgttgctaagtctgaggcagatggaattgacgaagaagctatttggaaatatgttattgatgcttcgaagaaggcttccaatcactatccatctatgcaccaggatttggtccaacatggtcgaaagacagaaattgattatctgaatggagcggttgtttttaagggcaaacgtgcaggtatctctacgccatactgtcagatgataacagatatgattcatgccaaggaaagtatgttggggttgagataggagaaagtcatgctgattgaagtggaaacgattgaagaatatttggctgccttgcctgaaaatcggaaggaagtagttgaacggctccatcaagtgattgtggaacagttaccagctggttttgaagtaggaatcttgggaggtatgattaactattatgtgccgcttgctgcctaccccgatggttatcattgcacaccgggagagcccttgccattccttgctttggcatcacaaaaggcacacatcgccctctaccacatgggaatctatatggaccaagaattgaatgattggttcgttgctgcttatcaagcacaggtgcctaccaaactggatatgggcaagtcctgtgttcgtatgaaaaatcccaagaatattccttatgaattgattggggaattggttagtaagatgtctatggagcgctatatagagctctacgaaaaaaatcatagaaagtagatgtagtgagaagaagtttttattcttggttgatgacccagcgcaacccgaaaagtaatgaaccagtagctatcttggcagattatgcctttgatgaatctgattttcctaagcaatcagataatttcgatgaagtcagtcgttttttggaggaatcggccagctttgccttttccatgtctgattttgatgcgatttgggaagattatttgggacattgatggataaaatagtacaaaatagccttgtttgggctatttttgttataatagagaaaagcacaggaaaaggagcaactcttgctagaacattcaattgatattcaactcaagcatccagatgattcatttagcctatttggttcgaatgaacgccatctgagattgatggaacaggaactaggtgtggttattcatgcccgtacggaaaaagtgcaggtgattggacaggaagaacatgtagaacaggcgcgtcttgttatccagtctctccttgtcttggtgagtcgtggtttagttatcaatacgccagatgtggtcacagctatttccatggcaaaaaatgatgagattgagaaattcgttgccctctatgaagaagagattatcaaggacaactatggcaaacccattcgcgtaaagacccttggacaaaaactctatgtggacagcgtaaagcgtcatgatatcgtgtttggaattggaccagctggtacaggaaagaccttcttggcggttactctagctgtaacagccctcaagcggggacaggtcaagcggattgtcctgacccgtcctgcggtagaagcaggtgaaagtttaggctttttaccaggggacttaaaagaaaaagtagacccttatttgcgtcctgtctatgatgccctctaccagattttgggcaaggagcagaccacgcgcctaatggagcgcgagattatcgagattgcaccgctggcctatatgcggggtcggaccttggaagatgcctttgtcatcttggatgaggcgcaaaatacgaccattatgcagatgaagatgttcctgacccgtctgggctttaattccaagatgattgtcaatggggatattagtcagattgacctgccacgcaaggttaagtcaggcctgattgatgcgacagagaaactaagcaaaattccgcagattgattttgtacatttttcagccaaggatgtggttcgtcacccagttgttgcccagattatcaatgcctatgagcaggaggctctggctgcggatggtcgagcaagttttgaaacgattggggagcctagtcggaaatacaatggcgaagagtagttgtttcattggctgatatataaaagaattgtgatgctagttacatttaatatacaataaaaagcccaaatggacgatactgtaagcgatgaaacaaacaggaacttagtccaaataagcgacttacagcatatcgtaaaatcacatcgtacagcaaatatcaactatttgtcacaagttataccaatcctattgcccgactcccttaaagcattgtcacaacgttgctttgtcaacggtatcatataaatctattaaaatattgctagtacttcaagttggattagagattaaatcttaacgacattttcgaaccagccctcattatagcggatagagatcataaaacctataactttatggattgttaccaataaaaaggctggttctatctgattcggattcgagatgggaaaagcagcatgaaaccgagttttactccctttcttttcgcatgttcggcaccgataagtatgaaaccctcgtggccaattgtgataaacctgtagactatataaaaaagcctccctttgtgttgtccgaacataaaatcccaagtattacatcggaaaaatacttgggattagatatcatagattaactgatcagagttaacttagagacactgattgatgacagggcttttatgcacgaataacaagaagtggcttaagaccaaaacttctctgcaatttcttggccttgtttaatttttgcccactgttgcgggatggccaattcattacctgaatcacatgaagcgaatccacattgatgtgacaagtagagacgctcttttggaataatcttgcttgcttcctcgagtaatttgtaaacacgttcttcatcatccaaatcagaagttttacttgaaagtagaccaagaacgacttcgacattcttgtcacgcaagctttccaaagcttttaaatcacctgcacgttcatcatcccactcaaggaagaatcgatcgtatttttggtcacgcaggaatttttcggcaatagcttcgtaagttccgccagctgcagagcggctttcatagttaccacggcagttgtgcgtccagacggtcaagccaatttcatgtccgtaatcaataacagcattattgatagcaacaaactcgtcagccaaagcggccaatgcttcagaatcgtcttgtggcaagaaaggtacagggttagcagggtcaaataattcccaaaggcagtcatcaaattgaacgatttgtccaccagcttccttgtactggtctaaaaattccttataggcagcgatgagcccgacttttaattcatcacgagtcttgtagacctgatttggtccaacttgtccattgaaaattgtcaattcattaaaggcatgggctggaccgaaaatagtttgtttggttacagtttctcctgctaattctttcacttgtttgaaaatatcaatgaaatggtgattttttgcagaaagtggagcagtaatacgcaatccaatatccttacgtgtttcaaaaatctgtccatcatggtctttaaatggataaccatgctcagcaatgtaacgctcgataccgtcgaagccccagagaaaatctaggtgccacattgaacgaccaaattctccatctgtcacaatatccaaaccgttttctttttgttctgcaacaattttttggatgagtgaagcttcagtttctttgtaaccatcgaagtcatcatagaatgggtatttgatgtcttcacgagcttcgatttgtcgtttaaattctcctaagtttgctggtcgaagaagtgaaccgactaattggaatcttgaagttgtcatatgtgtgtctctctttcgttttagtgatgaacctattctaactcataagctatcatttgaaaaatagttattttcatggcaaatccatagttaaaaactataacttgaaaaaatagaaggaaataactttctatcatttgtcaactatggtataatcaaaagtgctgaaatccgaacattaggagacttaggagaaaaatgaaaaaacaatcaccatttataattgcaggaatcgtcatgctaggggtcgtgatgcgtgccccctttacagctttgcctgctattttgatagatgtggcagcaggactgagagtagaagtgagttcattaggaattttaacctctattccgctcatcatgtttgctctctgttcatccttagcaccgcgtcttgcggctaagtttggcatggaaaaactaatggccctagtcttactggttatggtgctgggttcaggaatgcgagttctcaacttaccagccctttacattggtacaatgcttgttggtgctacaatagcatttattaatgttttgctaccaagtttggttgcggctaattttccaaagaaaattggtctgtatacgacgatttatatcactctcatgggggtggcggcaacagttgcatctatgattgctgttccaattgtatcctctagttcttgggaattttttattctattaattacaggattggtgtttatggctttcctgatctggttgcctaatgtaaaaaataaccatcgatttgcaagtgagaaccaaggaaaccagaaatcatctatctggaaaaataaagcagcgattgcctttttgatatttggtgggctacaatcagtcctctactatacagagattacctggttgccaactatttctcaatcagttggctttagtaaggcagaagcagggctaatggctggtttcttcaatatgacagctattcccatgtctatgattatcccagctgttctttctcgtcagacaaaagaaatgcgtcgaaatatcatgctggctatttcatctgttaccttacttggtttgttcatgatgtcattgattccgaccaatctcattctttggtcagcacttcacattattttaagtttttcaaatgcagccctcttcccttatatgatgttgagctttactttgaaaacaagcaacagccaggctactgcccagttatcaggaatggtgcagacaggtggctatctcattgcagcatttggaccaggccttctcggttacagctatccaatcttcggaaactggatgccattgattcttgctctggctatcgtcacacttgccatgatgtggactattgttctcattgaaagagaagatattatcttataaagtataatcccttaagaaggctggcatttttctgtgaaaatggcagagcttctaagggattttttgtcaaacaaaaaaagctggacatttgccagctttttaatgtgccacacgtttacgagcagcttttttacgattttcctcaatgaaagcttctttcttttcttctggttcaatgattgttttgtgaacagtgaagactgcgcctgctgcaagagcaactgtagaaagaacacctgtcaagaaacctttaccaaaacctttagccatagttatttctcctttacttgtgttataatagattttagcgaaaaaacaaaatattttcaaggaaaaagatgaaaactaaagttattgtggtcataggaccgacagcggtaggaaaaactgcccttggcatagacttggcccagcgctacaatggagaaattatcagcggtgatagccagcaagtctatcgcaaactggatattggtacggcaaaagctagtcctgaagagcaggctgctgcggttcatcacttgattgatgtccgagatgtgaccgagggctattcggcttatgaatttgtagcagaagccaaggctctgattgctgacattaaaagtcgtggcaagttgcctattatcgtgggtgggacagggctttacattcagagcttgcttgaaggctaccatctgggcgggctggttgaccaggagcaggtacttgcttatcgggcggaactcgactgcttgtctgacgaggatttggaaacaatggcagagcaggcaggtttgatggtcgagggaaacagccgacggagaatcattcgtggactggaattgaaaaaatttggcgaaaacttagaaaatacagagtcaggatatgagcctctttacatctgcctgacggatgacagacaggttctttacgaccgcatcaatcagcgagtggataagatgatggcggcgggcttactggatgaagttagctggctctaccaagaacacccagaagctcaagctgctatgggaattggctacaaggagtttttcccctacttagaaggtcaaatcagcctagaagaagcaattgataatgtcaaacaaaatagccgccgctttgccaaacgccaattaacctggtttagaaaccgcatggcagtcgatttttaccaagtatcagaagaagctgttaaggataggatttacaccgctgtggaggaatttttagatgattgaaacccagaaagaacaagaacgtgccctcctggtcggagttgaattgcagcagacagataattttgacgtgtccatggaagagttggcaagcctggctaagaccgctggggccctcgtcaaaggagtatatacgcagaagcgggagaaatatgacagcaagacttttgtcggttctggtaagctggacgaaattgcccagatggtcgaagctgacgagattgatactgtcatcgtcaacaatcgattaacaccccgccagaatgtcaatctggaagagattttaggtgtcaaggtcatcgaccgtatgcagctgattttggatatttttgccatgcgggcacggagtcacgaaggaaaactgcaggtccacctagcccagctcaagtacatgttgccacgcttggttggacagggcatcatgctcagccgtcaggcaggtggtatcggctctcgtggaccaggtgaaagccagttggagctcaaccgtcgaagcattcgcaaccagattcatgacattgagcgccaactcaaaacagtggagaagaaccgagcgactgtccgtgaacgccgtttgcaatcaggcgtgttcaaaatcggcttgattggctataccaacgcgggtaagtccactattatgaatgccatgacggacaagcgacagtacgaggctgatgaactttttgccacactagatgccacaaccaagcagattaacttggcagacaaatttaatgtgaccttgaccgatacggttggtttcattcaggacctgccgactgagttgatttctgccttcaagtccaccttggaggagtccatgaacgtggatctcttgctccatatcatcgacgcctctgaccccaatcacagtgagcaggagcaggtggtcttggacattctaaaagacctggatatgctggacattccacgtctagctctctacaacaagctggacaagaccgatgacagctttacccccagtcagtttcctcatgtcatgctgtccactaaggatgaaaatgccaaaggccatattcagatgatggtcttggccaagataaagaccatgtttgaacgatttgaggtcagggtgccacttgctgaatcttataaattgcatgatttagctactctggctctgattgaaaatcggacctacgaagaggatgtggaagtggtatcaggctatatcgcttccagcaataaatggaagttggaagaattttatgacggattatcttgatttggcaatcaaatacggtggttttaccagcctggacaaggtctatctggctaggaaattggctgatatgactgaccaacaaaaactagattttatcacgccaccgccttcggttatcaatgcctattttgcggaaatctaccagaaacaaggggcagaagaggcgacggactactatctcactctttctcagcagctctgcctttttccaaaagaacccagctttgctgaaagcaagccctttgtccgcctgaatttatctggtaagtctttcggatttacctatgtgtcggcggacggtctggcccaggttttttcggaagtaggagaggaagtgacggatagcttgctctttgaaatcgcccaagtctttccccactatgtcgtctttgtggaggagggcaagatttttatgaaagtcaatccctttgaggacgccgagttagaggaggttgaaacagactaccttttaacccaggtggcaaccggagaaggcttggtcaagatttcaggctttaatcaggaagaagtgctggaagtggcggacggctatgctggtcagcattactatgtctggtcgggtcgctctgcaattttatatataaaacattagaaagtaaacaatgcaaattcaatttttaggtacgggggctggtcagccctccaaggctcgaaatgtatccagtttggccttgaaactcttggatgaaatcaatcaggtttggctctttgactgcggtgagggcactcagaatcggattttggaaacgaccattcgtccacgcaaggtggctaaaatctttattacccacctgcacggtgaccatatttttggcttgcctggtttcctgtctagccgttctttccagtctagcgaggagcagacagatattgatatttatggacctgttggtatccgttcttttgtcttggcaagtcttaaagtatcagggacacgcctaccttatcgcattcattttcatgagtttgatgttgatacggtaggtcaggtcctagaaacagacaaattcacggtattcgctgaaaagctggaccataccattccttgtgtcggctatcgtgtcatccagaaagatttggaagggacattggatgcagaggctctgcgcgcggcaggtgtaccatttggtcccctattcggtaaaatcaaaaatggtcaaaacgtgacgctagaagatgggactgaaattatcgcgagtgactatatttctcctcctcggcctggtaaggtagtgaccattcttggtgatacgcgcaagtgccatgccagtgtacgcttggctgttaatgctgatgtgctggtgcatgaggcgacttacggaaaaggcgatgagaagattgctcgcaagcacgggcattcgaccaatatggaagccgctcaggttgccaaggatgcaggtgtcaagcagctcttgcttaatcatatcagtccacgatttttatccaaggatattagtcaattacggaaagatgcaagtactattttcgagcaggttcatattgtcaaagatttagaggaaattgagctatgagaaccattctaatcacaggtgcctctggtggtttggtacaggaaatggtgccattgctgaaagatgattttttgattttactaggtcgtgatgtggcaaaaattgagcagctctatgcttaccatgaaaaaaaggctgtctttgatgtagacatccgagacgaaatagctctgacggcattttttgatgaactggatagtcagtttggtcagattgatattctagtcaataatgcaggctatgccatttacgatgattttgagaatttttccagccagcaggtgcaggccatgtttgatatcaatacttttgctctgatgaccatgtgccgtttagtaggtaaacgaatgaaggcaagacggagcgggcagattatcaatatcatttccatgtcaggcttgattgcttcagctaagtcctcggtctattcagcgaccaagtttgcggccatgggtttttctaataccattcgcttggaattagcccagtatggtgtgacagttacaacggtcaatccaggtccaatcgcaaccagctttttcgatcaggctgacccggatggaagctatcaagagagcgtcaaggctttcttgctgcaaccagactatgttgccaagaagattgtttcagctatggggacgaagaaacgagacatcaatctgccttggtcactagcagctgctcataaactctatactctctttccaagaatagcagactacttggccagtacagtatttaatttaaaataagcatagaaaaacgccgaaataaaactcggcgttttcgtgtagactagctacgctcttttctacgtaaggcgatactgcctagaagtaggctacctaatgcgatagctatatagtttgttttttcacctgtttgaggtagttgttttgcctcggtagacttggtggtatgtactactgtagtagtttttggcgcctcatccagaatattttttggcatttcaggttgtggtacaagaatttctacagctggtaagtcttctaagcttgctaattgactaccaaatagggcgttggacacccaacggaagaagtgaacagggtggaccttgtttgttggattacctgcatagataaagacaggttggtcttgataatttccagcgatggcgacaattttattggctaatttgtcatgaccaggccaccaacctgcgatataataatctttatcagcgattttaacaagcgttttaaatccttcaggaatgccttcaatccaattaccggagttggaatagaaaagtccattcatggcgtagccacttgttaatggatctttatcatcaataatagcctgcatgagaccttcatagtcaccaccatctgtaaattgttccgcattgaaacctgctaagattcctaattcctccagtttttgcatggcgacaccacctacgatgataattggtttcttaccaaatacactggcatcgaattggtctgattcgagaatgatagcatcagcctcatctgcgctattgacaatttcaaagcccattcgttctaccgcaagtgcagcatttgcaagaatggcaaagtcgcctgcccaactataagagtgagaaggagcgtacaccttcattgctttcaattcttgtccaagaggcttcttatagagaggctcgccgtatagagcataggtgtccagtaagtgactaaattggttagtttccatgatgtagccatcgtctgtaaggtagaccttagcgcctgatttgatggcttgattaatggcctgaacggcgctttcagaggtgtttgcaacgacataataaggcgctttgaaatcaatttccgtagtacgtggagcttttgtccatgtgatgctacctaatttgccgctaaaggtgttttcttcaaatacagccttggcgctaaagcctttcatatctgggaagttgaccaccaattcagcatacatggctccccaagcagattcatcagaaccagcgtagaggacatggttagcgaatcctcgtttggcttgagccatatcgacaactaggtcgcccttgcggaagtttccaacatcttcagttaattccttgacaacaaccccattacgattgaaatattcaatcatcttaaatgcttcttgcatatcgttgtgtttatcgagcgtcataggaatcacatagtagtctgggaagaattttggctggtcttttttgacacgtccgacaacagctccgtctggtccgactagttcagactctgcttttggatcttctaccttattgacaccgcgagaatagtatttgaggcgcatttccataagactgtctggcttggttgccatattgtgaacaccgcccaaaacagcaaagaatcccgccttgaatgattcttgatttccttctggaatttcaatcgtgtgtccaagaatgccgtgatacattgcatacaccgctgtatagcctgagaaggaatcgtcccaaccatctccccagtggactttagggatggtgtagcgttcatatttagaatttgcaatacctgctcggcccatttcatgagctttttccagcataatatcggctagtaaatcatattcaaagttcgggtcatgtggcggagtggcaggctcgatgagaaatccagatacaaagccatgaatatctaaaacagatattggattccatttgtggatttgacggacgatggcttgtgtttctggattcacttggaaaccagtatcacggttagggtccaaaccatttactagtgaacgcaagtttttaacatcgccatcaggattttctgtgaaattgaacaagaagataaatttatctaacaaatctgtcacttttaaatgaagagtaacaggatttccatcggcatctgtagatgggaaggtgatggtatctttttgtgcaaattctttgaataggctagttaccacatctatgccgggttgttcgtcagcatgagtattgttgatgagaataggtaatctatagtcgaaggttccagcttgcaactgtttcagcatctggtcgggttgggtcagcatgagcggtgttgtttcagtaagatatttatcaatacttgcttgatttttagctacaacagccattttaatatctctaccttcagctgattgaccaattgactcaatccttactaggcggtcggtcgcagcattatttttcgtttcctcaatctctgtcaacatttcctcatgtgtacggtaggcttcataaggacggaaatgaagagtttttgaaattatcaggtttccatcggcactagtaccttccaacagcatatcttttataaaatgtcgataggtacggcgaatattactcggtgtccgtttactcaaatcttctccaaagagagctgcgagctggatattcaaatgaagttggttatcctgtctgctttcttctactgtgataaatgtatcgcctgtgaaatctccctctttcaaattccaggttttccattcggaaataggctttccatccaatatccattctattttttcagtcgtatctggaagagtgacggattctgtgatagtgactgcttccgatagatagacagtttttgtttcgagtgtaattgtatcaatagtcggtacggcaggtttttcttctgtagtattctgattatcattattagctgttctgagcgtagtttcctcggcatttggctcggaagatgttgtctcttcttctgtggaaacagatgcaggagaagtatctgctatttcttcagtttgtttttctgtctccttcccttctacaagattatctgtagcttcgcttgtgctagtcttcgtaataggagtctcttcaggcagtggagtcactgtttcattagtagtaggtggtatctcctctgtatttgcgaagaccgttccctgagcgagagatgcagctaaaagaactgttgaggcaagtaggacttgattcaacagccttttcttatatgaaagtttcatgcgaacttcctccttttgaaaatatgtacagggtaataaattaaaacgggttatttcatgcttatcttatcaaaaaatatatgtctttacaatataaattgaatatgtttatatatttaaaatattcagaaatatcgaatcatagagactatttattttgagtaggataatgaactaaaatctgttataatggtaaaaaaataagggagagatgtatggaaaaactttggaaaattatatatagtcggacatttattgtcattagtttgattattctaaccattttccttattctttggttggtaggttcggcagctacctatatgcctgctttattgattattttgcaaattttttcgatttttgtggctatttcaatcatcaatagaccgatgaataccagttttaagttaacctggattatttttgtcattggtattccgatttttggtgctctattctattttattttgcagtccaacattgaaaccaaacgttatcgtaaaaattttcataagcaagcacaaagacttcgggagtatagtaagacgtctgaaaaggtcatgaaggcattggagcaggaagataaggagcaactgaaattagctcacttcatgagtgagtacgttggctacccaattcataccaatacggatgccgtctatttttcaacaggtcaggaaaaatttgaagctctactagaagaattgaaaaaggcagagcagtatattttcatggagtactttattgtcgatatgggatatatgtgggattctatccttgacattttgaaggaaaaggcagcgcaaggggtggaagttcgttttatgtatgatgggatgaattcactgaccaatcttccctataattactataaaaccttgcgaaaatatgggataaaagccaaagtattttctcaaattatcccagccttatctacggtgcaaaataaccgtgaccatagaaaaattgcgattattgatggaaaggttgcctttaccggtggtattaatatcgcagatgaatacatcaacaagaaagtgcgttttggttactggaaagacgcagcgattatgattaggggagaagctgttgcaaactttacgttgatgttccttcaaatgtggaattacaatgaaaagacagagacagatgacctaaaatacctcaaaacgcataaagatttagagacggaaaccgttgatgccgaaggtttcttccttccgtatggcgagaatccatttgatggagatgaggtagccaaacgagtctgcctagacatgattcagtcggcaacggattatatttatatcatgacaccctacttagtgttggatgatgaaatgattgataatttgacttatgctgcgaagcgtggagtcgaggttcgcattctactaccgcatatctatgataaaaaatcagcctatttggctgctcgtactgattttccgacttacttggaagcaggaattgaaatctttgaatttcagcctggatttgtccattccaaagttgttttggtcgatgataagaaagctactgttggtacggtgaatatggattttcgctctttttatcttaattttgagtgcggtctctatatttacaatcactcggaagttttggcagctattaaggatgactttactcattccttcaaaaaatcacagcaaattaaccttctaaccttccataaaacgtactcttggtataagcgtttgggaggagccctactgcgaattatttcgccgttattataaattgtaatattcgttcttcatggagcaagggatcgacattctgtttcggtcttaccttgctccatttttcttggaaaatgatataatagaaagatagtttatactcggaaaatttacaggctacttgtgattttgagtattaaggagtaaaaaacgtgataaagcccaattatgactggcaattattgaccggtttttctgatgaacaatttatcaaaattgctaaaaaagaaggagtggacccggtagcggctaagttgctgtatgaacgtggcatccattcggcggaagaattgcatactttcttacaaccaagcttagaagaccttcacgatccctatttactacatgatatggacaaggcggtagagcggattcgccgagcaatcgaaaattacgaacacattttgatttatggagattatgacgcagacggtatgacctcggcatctattctgaaagaaactctggaggaaatgggggcagaagtccaagtttatcttcccaaccgttttacagatggctatgggccgaatcagtcagtttacaagtattttatcgagcaacaggggatttctcttattgtgacggtggacaatggcgtagcgggtcatgaagcgattgcctatgcccaggaaatgggtgtcgatgttgtcgtgacagaccaccattccatgcaagaaacccttcccaatgcctatgcgattgtacatccagagcatccagaaggaaattatcccttcaaacatttggcgggctgcggcgtggcttttaaattggcctgtgctcttcttgaaactgttcatgcagacttgctggatttggtcgcaattggcaccatcgctgatatggttagcttgaccgatgagaatcgtgtcatggtcaaatatggtctctcgcttctcaaacagactgagcgagcaggtttgcaagagttgataaagatagctggtattgacatagacagtattgatgaagaaacagttggtttccaacttgctccgaggttgaatgcccttggtcgactcgatgatccaaatccagccatcgaattactgactggttttgatgacgaagaggcccatcaaattgccctcatgattgacagtaaaaatgtagaacgtaaagacgtcgtccaagcaatttacgatgaagcaaaaaccatgctccgtcatgatagacctgttcaagttctggctaaagaaggttggaacccaggtgttttagggattgtagcaggacgcctactagaagaactgcagcaacctgttatcgtcttgtctattgaagatggtaaggcaaagggttcggctcgttctgttgaagcagttgacattttcaaggcacttaaagatcatcaggacctatttatcgcctttggtggtcatgctggtgcagcaggtatgaccttggaagttgacaaacttgaagagcttgctctgaccttgacagactacattatcgaaaataaattggatttatccagcaagtcttcgctggtcttagatgaagaattggatttagaggaattaaccctagatactctaaaatctttcgagaagcttgcgccttacggcatggataataaaaagcctgtattttacatcagagactttcaggtggaatcagcaagaaccatggggcagaataatgcccatttgaaactacgcattactaaaggtgctgctggatttgatgttcttgcttttggtaagggcaatctagccttggaattttcacaggccaagggcttagaactagctgtcaccttgtctgtcaatcaatggaatggcaataccagtcttcagctcatgttggttgatgctcgggtcaatggtgttcaactttataatattcgtggaaaacaacatcctattcctgcaggggtcccaattttggacattgaaaatccagtagcagataacaaagcaattgtcttggctaacttgcctgaggacctcagtagtctgcgtagctattttcaggaaagagaatttgaagccatttattttaaaaacgaaattgccaaaccgtactatctagatggttatggtagccgagaacaattcgctaaattgtataagactatttaccaatttgaagagtttgatgttcgctataaactgaaagatttggctgtttacttaaaaattaaggacagtctattggttaaaatgattcagattttccaagaattagaatttgtcacgattgcggatggggtcatgcgggtcaacaaagaggcacagaagcgagagatttcagaaagtcaaatatatcaagaattgaaagaaacagttatccaacaagagttgatggcgcttggcaccgttcaggaaatttatgaatggctatgtggtcgcgtttgatgacagtagaagctctggttgttggagtgattggaacgcttctctacacttattggtttatcaggcaaaaaggtttgttgaaaaatcttgaacagataaccgaaataaagcacgcactgattgaattacggcgagtaggatggtcagaaagagccatcaaaaaggtttttctgaaacaactgttgcctctaaaacaagaagacatcccagcatttgttcaaaatttcataaaagaagctactatttttgcctcaactagcttttatcagttgataagagttgacagtcgctctttaagccaagagaaagcgacggccttattggagcaatgtatgaatatgttagattttcctgaggaattaagtcatgggatattacctgaacttttgcagaagatggatgtgaattgtcctccacaccatccgttttggcggtactttgctaagctagttgataaggcttttccagttcgggaattagaagtcaaacggccgttaaacagacaggtccatcagctacgctaccttatttcctatcagcagactttttgggtgcgtcagcagtttggaaaaggaaaaacagattggcaggctctgatagcctatgtacgtagcctacctcggtggtcttatcgcttacgagaatctgcccgcctacacaataaacaactgttcggcaagaaaaatcagaagaccttgccagtcaatatgaagattttgattcattttcacagcgaatttatcctaaatcaagatggacaatttgccttgattttagaagaacgaccgcatgtcaatggcgtggtaaatggggcttcctttaattatgccagagctaataataagcgggagtgggaaagaactcgactggtctaaaaagagttcgtcttcccacccccgcacagttgattaggttggatttggagtgtaaaacacgaacaaatccgccaatcaaccactgcactgagatgttgacacgaactctaagaagtggcgctgagctttttgccctgcctctccagttggcaggcaggatcccatttttcggaaagaattgctacgctcaaagatgggagtctatttatctcctactcgctttcgtcgctaccaaaaaggaagaaatgaggttggctgggagcagtcttactttaatcagcaaggaagcttttcctatggtggacatagtagagcagcttgtgtggcgaatttgaggagacgatttgctaaagatatatgtctgaaatgtaccaaaaaacaatttcatggtataatgaagagtaaaaattatttttaaaaagagagagacaaatgaacttaaaagattacatcgcaacaattcctaactatccaaaagaaggtatcgaattccgtgacattagccctttgatggcagatggaaatgcttatagctatgcagtacgtgaaatcgttcagtatgcgacagataagcaaatcgatatgattgttgggccggaggcgcgtggtttcatcgttggatgtccagttgcctttgaattgggaatcggttttgcaccagttcgtaagccaggtaagttaccacgtgaggttatctcagctgattatgaaaaagaatatggtgtagatacattgacgatgcatgcagacgcaatcaaaccaggacaacgtgtcttgattgtcgatgacttgttggcgactggtggtactgtaaaagcaacgatcgaaatgattgaaaagcttggcggtatcgttgctggctgtgccttcttgattgagctagatgatttgaaaggccgcgaagcaatcggtgattacgactacaaggttttgatgcactattaatctaaggttatagccaaaacttataactggtcctatttttattctaattgaattgcatagcaacctgtcttataataaatataagaaaattgggaggttgcttatgccaattaaaattgaaaaatcattaccagcagttgaaattttgagaaaagagaatatttttgtgatggatagtgaccgagccagtcatcaggacattcgtcctatcaaaatccttattctcaatctcatgccacagaagatagtgacggagactcagttgctccgtcttttggctaacactcctttacagctagaggttgaatttctctacatggctagtcacgagtccaaaaatacacactcgggccatttgaagcagttttataagacttttgagcaggtcagggatagctattttgatgggctcatcgtgacaggagcaccagttgaaaatttaccttttgaggaagttgattactggcatgaacttactcaagtttttgattggtcaaaaacacatgtttattcaacattgcacatttgttggggtgcacaggcaggtttgtatgcacgctatggtgtacccaaacacagtatgtctcgaaaactatcaggggtatattgtcaagaagtgactaatccaacgagccctcttatgcgtggatttgacgatgaatttcgttcaccacattcccgttatacggaagtaagagaagcagatattgcccatctgagtgggttgacgattttatcacaaggtccagaagttggcctatccattctagccagcaaggatttaagaggaatttatagttttggacatttagagtatgatagggatacactagctaaggaataccaacgtgattgtatagctggaaaaaatccccatttaccggaaaattatttcaaaggagatgaccctacaagcaaaccatctctctcttggaatttaccagcagcacaattctttaccaactgggtgaattatgctgtctatcaagaaactccatacgactggcatatctttgaacaatcagcccagtcagctagtctttaaagaggaagtatgaactattcacagcaatttcgtcagggacatttggtcctgccagcagcaatattattccactatcaagagctttttccgtcggcagatgattttttgatttggcagtttttcttatatcaaaattcttcagctatcgaatcattagcgcctagtgagattgctcaagctactggtaaaacagttgctcaggtcaatcaagctattgaaaatctccaagatgctggactcttagaatttaagacaatcagtattgctggtgaaattgaaatgatattcgatgcgcttcctgcttttgaaaaattggatgttctgttaactccaaaacaggcagttgagattgtgcaaccagagaatgatttgaagaccttggtgggtgattttgaacgtgaattgggccgctttttatcgccgtttgaaattgaagatttgcagaagactattgaggatgacaaaacttcgattgatttggttcgtgcagccttgaaagaagctgtttttaacaacaaaacaaattggaaatacatccaagctattctacgaaactggcgccgtgagggaattactacagttgtgcaagtagaagcgaaaaatgcagaaagagaaatccagactcctaagaatgtgactgtttcaagtgactttcttgatgcaatggatctctggaaagattgatatggaaacaaaattatctaaaaggctggaaacagtcgcaagttttgtcccacaaggggcacgtctagttgatgtagggagtgaccatgcttatctccctctttttttggtagagcaggggcgtattgattttgccattgcgggggaagtcgttcaaggtccctatcagtcagcgctccagaatgtagagcaggcgggacaaacagagaaaattctagtccgtttggcaaatggcttaggcgcgtttgagaagtctgaccagatgactgccgtgaccatagcaggtatggggggacgcttgattgcggaaatcttagaagcaggaaaagaaaagcttgcgaccattgaacgtttgatactccagccaaataatcgtgaagatgatgtgcgtcgatggttggaaaaaaatggttttagattggttgctgaaaagattctggaagaaaatggcaagttatatgaagtcctcgttgcagaatcaggacagatgagattgtcagaagttgaacgtcgttttggtccctatctactagaggagacctcgccagttttcgtcaaaaagtggagaagagaacttgaaaaattaagttttgctttggaacaagttccatctgaacgccaaggtgaccgctttgccatttcccaaaagatccaacaaattcaggaggtagtccatgttagctagtcaggttattgagcgctatcaagccttttgtccccattctttggctatggaaggcgatgtcaaagggctgcaaatcggtacccttaataaagagattcaacgtgtcatggtggctctggatattcgtgagacaacagtggcagaggcgattgataaaaaggtagatttgattatagtcaagcacgctccgatttttcgtccaataaatgatttggtggctgacaatccgcaaactaaaatgtatcttgatttgattaagcatgatattgcagtctatgttagtcatacagatattgatgtggttgagggtggtctcaacgactggttctgtgaactactagaaattcaagatactacctacttgattgaaactgccgaggggcaggggcttggccgtgtggggacaatagcagagcagactttggaagaattggctttgaaagtcaagtctgtctttgatctagatgctgtccgtctagtgacctatgggcaccaagccaagcagtatgtcagccgtgtagccatctgtggaggcagtggtgggtcttactaccatgaggctcttgctaagggggcagatgtttacatcacgggcgatatttactaccatactgggcaggacatgctgactcagggcttgctggctattgatccaggccatcatatcgaagcattatttatcaaaaaaattgctgaattgttggaaatatggaaggcaaaagaaggttgggatgtcgaaattctaccttcaactgtttcaaccaatccgtttagacatttgtgataaattaatcagcacttgattgtggaaagaccaagacgacatttaatgtagttttaggtcttttattttttagatattttcttatttatttaagtgaaaaagcttgaattttataataaattagggtatcttactttataggatatgcaagattaaacaggataggatgttagttatgacttgggttactaatcagtctgtagttctacaggctttgctaggtggtttattcacatggttttgtacgattgtggggtctgccgttgtatttttctttaagacagttagtcgtcgtttgctagacaccatgttaggctttgcagctggtgttatgattgcggcttctttttggtctttattagccccatcgattgagtatgctgaaagttcatacggcaatctggcttggataccagcagcagtaggttttgcagcaggtggtatttttttacgcttggtagatgcctgggttccgcatttgcatttgggaaatgataaagataaggcagaaggtggtggtgagaaggatagaaaaaatctatccaaaacagccctgctcttcttagctattacaattcacaatattcctgaaggtttggcggtcggtgtgatatttggtgcacttgcttctaactatagtccagcagcttttatcggagcaattggtcttgctattgggattggtatacaaaatattcctgaaggggcagccttggctattccaattcgtacagacggcgcatctaggtggaaagctttttactggggatcaatgtcagcaattgtcgagccgattgcagcagtcatcggtgcttttgcggtcacttttatgacacctattttaccttatgccctctcctttgcggcaggggccatgatttttgtcgtcgtagaagagctcattccagaatcgcagacaaacggcaatacggatattgcaactctgggcttaatggctggttttatcatcatgatgattttagatgttgctctaggataatttgttaaagtctgtcgtcacaggcttttttcttatgacaatatctttaaaaatatggtataatgaactgatattaatttagggaaggtactcttatatgaaaggtattattctagcaggtggttcaggtacgcgcctttatcctctgacacgtgcggcttcaaaacaattgatgcctatctatgacaaaccaatgatttattatccattgtcaacattgatgttggctggaatcaaagatattttgattatttcaactccgcaagatcttccacgttttaaggatatgttaggagatggttctgaacttggaatttcactttcatatgcagaacaaccaagtccagatggtttggcgcaagcctttattatcggtgaagaatttatcggtgatgacaatgtagccttgattcttggtgataacatctaccacggaaatggtttgaccaagatgttgcaacgtgctgctagcaaagaaaagggagcgactgtctttggttatcaagtaaaagatccagaacggtttggtgttgttgagtttgacgctgatatgaatgccatctctatcgaagaaaaacctgaagagccaaaatcgaattttgctgttactggtctttatttctatgacaatgatgttgtggagattgcgaaaaatatcaagccttcacctcgtggcgagttggaaatcacagatgtcaacaaggcttacttagaacgcggcgacttgtctgttgagcttatgggccgtggatttgcttggttggatacaggtacgcatgaaagcctcttggaagctgcacagtacatcgaaacggttcaacgtttgcaaaacgttcaagtggctaatttggaagaaattgcttaccgcatgggctacattacaaaagaacaagtgtataaattggcacaaccgcttaagaaaaatgaatacggacaatacttgctccgtttgattggagaagcttaatgacagaaaactttttcggtaaaacactagcagctcgcccagttgaagctattccaggaatgttagaatttgacattcctgttcatggcgacaaccgtggctggtttaaggagaacttccaaaaggaaaaaatgttgcctctcggctttcctgaaagcttctttgcagaaggaaaattgcagaataatgtttccttctctcgtaaaaacgttcttcgtggtcttcacgcagagccttgggataaatacatttcagtagcagacggcggtaaggttttgggaacttgggtcgatctacgtgaaggcgaaaccttcggtaatacctaccaaaccgttatcgatgcttcaaaaagtatcttcgttccgcgcggagtagccaatggtttccaagtcttgtcagatttcgtggcttacagctacttggttaacgactactgggctttggaactcaagcctaagtatgctttcgtcaactacgctgaccctagcctcgacatcaagtgggaaaacctagaagaagcagaagtttcagaagcagatgaaaaccacccattcctcaaggacgtcaagcctttgagaaaagaggacctctaatgtttcaagcctttttggaaatagcagagcagttaaacaagttaggaatcactcccttgttaatgggttctgttggtctggaaaggcggacaggacgagattggcaggcaagggatcttgatattcatgtgcccagtgacccacggggatgggaagcgccagatgaggagcggatttaccgtgcagatgagctgattgttctgatgaatcaacttggctatgtcctggttgatcgtcatgaacatgaatttcataaagacggcttatctgttgaattcggaggcctacattcactgcctgaatttgctggtgtagagctagaagatttggaagaactagaaacagtaggtgttcgctattacctaccgacacttgaacaatacctgaaaatctaccaagcctcttcaaaagattcctaccgtgcagaaaataacaatcaaaaagactttgctaagattgcttacttgaaggaaatcttgaggtaaaaaagcgagcgaagcgagcagttctgtgtgtcatcgccgtagtgagaagctcctttgctttgctaaggagcgggggaaaccatgagaccttaggctcatggtttagtaatgaaacaccttggcggttgcttacgaccccactacctaagatgacacacaaaaaagaaaaaaacttttcggagaaaaaaatgtctcaatttaaaaatattatcgtgactggtggagctggtttcatcggttcaaactttgtacactatgtatataacaatcatccagacgttcacgtaactgttttggataaacttacttatgcaggaaacaaggctaacttggaagctattcttggtgaccgtgttgagctggttgttggcgacattgcagatgctgagttggttgacaaattggctgctaaggcagatgccatcgttcactatgcggcagaaagccacaacgacaactctctcaacgatccaagcccatttatccataccaactttatcggtacttacactttgcttgaagcggctcgtaaatacgacatccgtttccaccatgtatcgaccgacgaagtatacggtgaccttcctttgcgtgaagatttgccaggtcatggcgaaggtccaggcgagaaatttactgcggaaaccaactataacccgtcatcaccttactcatcaaccaaagctgcttcagacttgattgtcaaagcatgggtgcgttcatttggtgtcaaagcaactatctcaaactgttcaaacaactacggtccttaccaacacatcgagaaatttatcccacgccaaatcaccaatatcttggcaggtattaagccaaaactttacggtgaaggtaaaaacgtccgtgactggattcataccaacgaccactcgacaggtgtttgggcaattttgacaaaaggccgtatgggtgaaacttacctaatcggtgctgacggtgagaagaacaacaaagaagtgcttgaattgattcttgaaaaaatgggtcaaccaaaagatgcttacgaccacgtgactgaccgtgcaggacacgatttgcgctatgctattgacgcaagcaaacttcgtgacgagcttggttggacaccacaattcacagacttctctcaaggtttggaagagactatccagtggtatacagataaccaagactggtggaaagctgaaaaagaagctgttgaagccaactatgctaagacacaggaagttattaaataagattattaaaggctagggctcttgcccaagcctttcttgaaataaggagcaaatatgattttaattacaggtgcaaatggtcagttgggtacagaattgcgttatctcttggatgagcgtggtgttgattacgttgccgctgacgtagcagaaatggacatcacggatgcagataaagtagatgccttctttgcagaagtaaagccaagcgttgtataccactgtgcagcctacacagctgttgatatggcagaggatgaaggcaaggaactcaactacaagattaacgtaacaggctctgaaaatgttgccaaggcaaccgctaaatactgtgcgaccctcgtttacatctcaacggactatgtcttcaatggtgatttgccagtcggcaaagagtggcaagtagatgaccaaccggatcctcaatctgaatacggtcgcaccaagcgcaagggtgaggaagcagttgagaaatttgctgacaaattctacactgttcgtacagcttgggtctttggtaactacggtaaaaactttgttttcactatgcaaaatcttgcggaaacccgcgatactttgacggttgtcaatgaccaacacggtcgtccaacttggacccgtacccttgcggaattcatggtacacttggtggacaccaagcaagcatttggttactaccatttgtcaaacgatgcagcagaagatacgacttggtttgactttgcgacggaagtcctcaaggataccaacaccaaggtattgccagtggattctagccagttcccagccaaggcaaaacgtccattcaactcaaccatgagcttggacaaggcaaaggcgacaggttttgtcatcccaacttggcaagaagcattggaagcattctataaacaagaaaagaaatagtctacaggagatgtgtatgaaaaagaaagcgattgttaagccgttgttgatgtcaggaatttttctggctttactaggaggtgctacattaccgtccggagctgttccagttgtagcagcagagacaagtcaaagtacgacctatcatttaactgatgatgaaaaagttgccgtacgtgaatatattcaagctaaaatgactatcgatatgcaagaatatagattggcgtttcttgagggaatgatggaagaaatggcttcgggtagtgctgaagctgcgtgggatgaagaaattgcagacttgaaggcaaacttaacagcagagcaagttgttgttttagatgaactcgaagcaaatttaattggtagcatagcccaacattaccattacttatttgagacacttacagtcgctggaaaaagcggaagagaagaagcggcggctatagtttctaagtacgagtctgaagatgatgcaagtactcctgaagccgaattggctgcattgaaatacgctagagaagttatcgttgaactactgaataaagagtcggcagcgattgataattatattgcttatgcagaagcaactggacaagaattagctggattattggaaagtggaaactctaatttagaatctattacatctgcaactataggatatggtcaagctcttgcaactgcttcgcaaccaaaatttccgtatgacttttcagaaatggaccgacagattgcagaactaactgctagtctacaatcaaaagtcgaggataaaagtacagctaagactgaaaataccggggtacaaacaagtcaaagcgctacaaatggctcaaatgatttgcagaccgttccagatcaagggggcggtcagatttctgatgtagctacaggcaaaggcaatatttccgaagcaggtcagaaaaaggttatcccaaatgataatgctaaggtattgccaaaaacttcagggaaatctagtcttccattaactgtactaggactcataacaatttttgctggttggttattgacaaataagcaagaagaaaaatagaagattagtgtaattgcatctattttgagaaatatagttgtttttacatgtgaaatacataaaggagatgtttgtgaaaaaaagaacgttattatttctttctttgtgtgcatccgcgttgaatgctcagcttgttcaagcggatatggtaaatgccccatctagtcaagtttcttcatctcaggttgctgaaactggcgggcagttatctgtcgttgatgaggctggtcagattaaagctattctatcgaacattcaaggggaaattattggtgttacagcccagtttagctctgaaacaaatagcggcattactgtcacattctcaatggatgagcagggtagatacgtagcggttttggatcggtctgcatttgcggaggaagaccaagtcttttcgctgaagttaacagcacaattaacagatggaagttttcagaccttatcagattatagtttcgagtggaagaaggatgtcgtaagcgcggctgagaagcctactgctttggataatagtgatgcaactccgtctaaaattgaggaggaagcaacttcgactactacaagctcaacggttaattctagtttgacagcaggtgcaacaagtagtacttcgaattcgctgacaagaagttcttcaaatacgattgcaggaagttcgaatggctctacaagtgttccaagtgctcgagtcagtacagcttccagttcggtcaatgttacacagccaacaggtaccatcacaattgaaaatcgtaacgatgcccaaggcaccttcgatgttcgtgttactaatgtttcatcaccgaaagatatagcaagtgttctcttacctacctggtcccagtcagacgatatacgttggtatgaagctactcgtcagtcagatggcagttataagttaactgttaataagaaggaccataagtatcgtacaggtacctacacggttcacttatattataaggattcaaatggtggtttgacaggtgcaggtggaacaacaactcatttatcagaagcgaagccaacaggtaccatcacaattgaaaatcgtaatgatgcccaaggtacctttgatgttcgtgttactaatgtttcatcaccgaaagatatagcaagtgttctcttacctacctggtctcagtcagacgatatacgttggtatgaagctactcgtcagtcagatggcagttataagttaactgttaataagaaggaccataagtatcgtacaggtacctacacggttcacttatattataaggattcaaatggtggtttgacaggtgcaggtggaacaacaactcatttatcagaagcgaagccaacaggtaccatcacaattgaaaatcgtaatgatgcccaaggtacctttgatgttcgtgttactaatgtttcatcaccgaaagatatagcaagtattatcttacccacttggtcacagacggatgatttacgttggtatgaagctactcgtcagtcagatggcagttataagttaactgttaataagaaggaccataagtaccgtacaggtacctacacagttcatttatattataaggattcaaatggtggtttgacaggtgcaggtggaacaacaactcatttatcagaagcgaagccaacaggtacaatcacaattgaaaatcgtaatgatgcccaaggtacctttgatgttcgtgttactaatgtttcatcaccgaaagatatagcaagtattatcttacccacttggtcacagacggatgatttacgttggtatgaagctactcgtcagtcagatggcagttataagttaactgttaataagaaggaccataagtaccgtacaggtacctacacagttcatttatattataaggattcaaatggtggtttgacaggtgcaggtggaacaacaactcatttatcagaagcgaagccaacaggtacaatcacaattgaaaatcgtaatgatgcccaaggtacctttgatgttcgtgttactaatgtttcatcaccgaaagatatagcaagtgttctcttacctacctggtcccagtcagacgatatacgttggtatgaagctactcgtcagtcagatggcagttataagttaactgttaataagaaggaccataagtatcgtacaggtacctacacggttcacttatattataaggattcaaatggtggtttgacaggtgcaggtggtacaacgactcatttatcaaatccgtcggcacagcgatcctacacagtctatattgacccagggcacggagggcgagactcgggtgcttcttacggtggcatacatgaaaaaaatcttgcattgtctgtttcaaataagttgcgtgaaaatctcttgcaatatggaatcaatgttttgatgacccgtacaggtgattatgatgtagacttcaaaacagagaggtcacgaatgacgaatgcaagcaacgcagacttatttattagtatccattttaatgcgacgggtgcaggagtttcgaatgcgactggtatcgaaacatattggtatcaatataatccagaataccaacctaaaattaataaagaaatgcataataaccctactcgtttagctgaaagtgagattttagccaacaaggtccaggagagtttaattaaagaaacaggtgcagttaaccgtggtgtaagaagagaaacttttgcagtccttcgcgagacagcaattcctgccattctagtggagctaggatttatggataatccttcggagttgcaagttatcaaacaagattcttaccacactcgccttgcgaaagcattggcacaaggtgtaatgaattggtatggtgctgttgagggaaagtagaaattgcaggtacaggtattgaaacaggaaaactttctaatgatcaaaaaagtttcatagccaatctagtacctgcaattgaacaaagttcaaaagctaattctatcctttcgagcgtcatgttatctcaagccatcctcgaaagtgcatggggaacgtcatacttggcgactcatgggaataatctttttggcatcaaagcggatgctgcgtggacaggtgctacaattgaaatcattaccaatgaataccgtgatggtgagaagaagcaagaaaagcacttgtttagaaaatataattcatggaatgaaagtgtagcagactatgctaagttctttacctctactccgtggagaataaaaaattaccagagtttcagagaggcaactgattatcaacaagcgattcttgcgctaagacaatcaggatatgctactgatccgaaatatggtgaaaaattacgatcaattatcgagaattacaagctttatcttttagataattaagttttttgggtgattgatgataaaatagccttgctcaaaaccgagcaaggctatttttatcactcatataaatctgttaaaggttgtttgtcaatggcactattgtattctagttgtaagtaggtttggtaaagtggtagggttgataggtcttcaatttgttggccattattatcgatatttccccagctagtaatgataggtgcttcgatttgcatatcactcaaaaattgttggtaaggtgatcgaggaagggcatagtcggattcggataaaatatccatcaaatatggaacgagatagtttgggctgattgttgtagattcgcgctccctaatatcaaaattcgaccaaatcactaaaggggtagaatatttagcggcaggattattttcatccataaattgtgcgtaaaattcctgagtcaaactaggttggtgatcgccgtacatgacgatgactgttggctctttgtaagtactaaagaaagtaattaaatctgcaaatgcttcatctgttcttttcatgctggtcaaaaattctgtttcagctaagtattcagatgttgaaccattaatgctgacttcgcgaggataaatttcttccgtacttggatagcctccatgtccttgcatggtaacaacaaagctaaatagaggctggtctcctttttgggtataaagttcttttattccgttgaacaagaattgatcagatggccagccacgatcgattgttagtggtgctaagctactaatagcaggttccgaatctaaaaaataagatttattaaaccccagtagaggatacactgcattgcggttgtaattatttccggattgaggatgtagagctacagtgtcgtaatttttattttttagataagttgcgaaacttggacggtcttgtgtgataatctgctgatatgggaataaattagaagataataaactgattgggttacttgtcagcacttcatactcggtatttgcagtaccaccgccaaagactgagacattgagggtgccatgaatagtattgtctgttaaagcatgttggtttgatagcggattaggctccatatttaagccctgtaagtttgaaaaatcactctgtgattcattctgtataaagataatattaggtctgattgtttgtttttctgtttcaggagggtacttctcaagaacttcattaagtttggggactgagtatccttcaggcttagttattttactatcttcatagaaagaggcgagtgagagtggtagcccaaattgaccataggtgacgtacattctccagtagtttaatgatatatttgcattagagacgacagttttattaatcattggaacgattgttattaaagttatatagcccagtaaaattctgctgaaacgtttcggccatttgaaatcataactagaataaaacgttctagaaggtagaagttttggtaaatataatttggggataaagaaaaagaaggtcaataagatataagaaaataccatactttgtagcattcgattgttgatattaattgctacgctagaagctacatttaatccgtctgtgatttgaaaaagattataaaataatagaggagcaccacggctgtcaatcaaaagttggttacttataccaataaatactgaagcggatagaattaataggctggcaaatcgtaagttagttgtaaagaccagtattaggtagaggactccgataatgattagattgttccaaagactattggaggaaagagtagagaattgtgagtagctattttcaataataaataatgaaaaaatgggaactagaagataaattactgatagactaatcgttttgaaggctttagagatatgacctcggagttgtttgtatcccaaaagactaaaaaatataaggtaagtcagtgcaactaatagctgttgagtttccattttattaaagttcgaattaaatagcactaattcattgcgatataaacgtggaaatgtaaaagtagtgaatatatattgaacgattaataatattgttaagatacggatatctcttcttttgattctccatgttgctccatttaagataaagcatgttagacctaaagcaaggactattaagtggaggtaccaaaattgattatctttagttatccgtaaagtatagggaagctcaataaaggctaaatttttatatttatctccagttgatgtgtcaatggattcaaccaattgtccaccgactttaatttttacaatagtcggattttcactaacaaagtattcaaatgataaggttcttacagaagaggaagatttaattacgagtgaattttcctcacctagagaagaaaaattgggaattaaatcagcgtcattgattccccattggttttctataatttctgatgaatgaatataacgtccatttatttggatgctgtcgattacttggtttggttgttctgcgattatttctatagttccatcattttttgtagaacctaattcgttttgaatgaggtgtgcatagagaaaaaaacttccaatcaatccgatggagattagtatgtgaataagctgtttgattaatttcatatttattaacaattctaagttttatatttttatgtaaaagccagtacatattatatcaaatttttcttattaactcaaaatttgtttttatctatactgtggagtcagaggcgtagaaaaagaaaagcctttataaccaaactaggatagaattaggaaaaaaaactaaaaaatggtataatgaaaagaactgcaatttgatggagaggattcatgaaacacgtttttattatcggtagtcgtggactgccagcaaaatatggtggctttgagacctttgtccaacaattggtcagtcaccagcaatctgagaagatttgttatcatgtggcttgtttatcggatacaagtcatcaccaacattcgacctacctgggtgcagattgcttcacaattaatccaccaaaacttggaccggctcgtgtgattgcttatgatatgatggcgatcacttatgcccttaaaatcattaaggaacagcagatagagcgaccaattttctatatcttgggaaataccataggtggcttcatagtaccttttgcgaaacagattcactctgttggaggtaccttgtttgtcaatccagatggtttggaatggaaacgggccaagtgggctaagccagtccaaaggtatctaaaattttctgaaaaaatgatggtcaaatatgctgatttgattattgctgataatgagggaattgaggattatattcaatctgaatactcggctaccaatacacgctttattgcctatggtacagatttaagtccgactaagttaacaaaagaatctgagcaagttcgccaatattttacaaattggaacattaaagagaaagaattttatctgattattggtcgttttgtacctgagaataactatgtgacagcaattagggagtttatggcaagtaacacgagacgtgatttagtcatcgttgcaaaccatgaaggctctgcctattttcaaaaattgaaagatgagacaggctttatatccgataagcggattaagttcgtaggaacagtatatgaccaagaactacttaagtatctgcgccaagaatgtcgagcttatattcatgggcatgaagttggaggaaccaatcctagtctcctagaagcgctggcgcaaaccaatgaaaatttggttttaggtgttgattttaaccgcaaagttgccctagaaggtgctcggtattggagtaaggagtcaggtagcctgagtcaattaattaaccaaattgatgagaatgctgaagcgatggaattaggagaaattgcgaaaaaacacatgaaggatgaatacacctgggaaaaaatcgtccaagagtacgaggaattatttttacaatgaaagtaaatatactcatgtcgacctacaatggtcaacagttcttagctgagcaaattcgctctatccaagaacagtcatacatagactggacactattcattcgtgatgatggttccagtgatcgaactagagagattattaaagattttgttgaacaagatcagcgaattcacttcatagatgttgagacagacgaaaatctcggtgtcatcaaaagttttcataggctagttcattatgatactgctgatttctattttttcagtgaccaagatgatgtttggctaccaaataaactggaagttagcctgaaaaaagcacaagcctatccaacaaatttgccattgatggtttatatggacctcaaagttgtcaatcaaaatctagaagttatggcagaaagcatggtaaaatctcaatctcatcatgccaatacggaattggtgcaagagttgactgagaatactgtaactggcggtgtcgccatgattaatcatcatcttgctgaaatgtggcaagtaactgaggatattttgatgcatgactggtatttagctttgttggcctcggctttgggtaaactggtttttattgacaagcctggcgaactctatcgccagcattctgataatgttttaggggctcgaacactctcaaaacgctttaaaaaatggattcgccctcatattttatttgcagtttattgggacttgattaaaaatagtcaaaaacaagcccggcatttattacaaatgcccctttctcaatcaaatagagaattaatagaagcctttgtaaccattatggataaaccaatgcttgaacgattcaggattttgagaaaatatggtttaagaaaaaacaaaaccttccatacattagtattcacaacactgattgtgacaaaatttgcatataaggaatagttatgaatttattaaataaagaaaatcaaatactcttaagagagatgattaaaacagattttaaattacgttaccaaggttctctcattgggcatctctggtcgattttgaaaccgatgttactttttacaattatgtatttagtatttgttcgttttttgcgctttgatgatggaactcctcattatgcagtagggctactattgggtatggtaacatggaacttttttacagaagcaactaatatggggatgatgtctattgtttcacgcggagatttgttgcgtaaattgaatttttcgaaagaaattattgtcttttcttcagttgcaggagctgcaattaattacgccattaacttaatggttgtgtttgtatttgctgctattaacggggttccctttacttggtccgttttagttataatcccattgttttttgaattggcgttactagcaacaggtatagctttcattctatcttccttatttgtaagatttagagatattggtccaatttgggaagtgttcttacaggctggattgtatgcgacaccaattatttattcattgacatttattttacagcgtgggcaagtaacatttgctaagttgatgatgttgaaccctgttgcacaaattattcaagacttgagacattttattgtttattctgggaatactacagttagtgaattgatagaaaatcctgttattgtggcaattccgtatattcttccagtcgttgtttacctattgggtataactgtgtttagaaaaaatgccaaaaagtttgcggagattttgtaatggtaaaaaataataatattgctgtgaaagtagaacatgttagcaagagttttaagcttccaacggagagtagtcagagtctaagaactactttagtcaatttatttaaagggattaaaggctacgtagagtataatgttttgcaggatatcagtttcgaagttgaaaaaggagatttttttggaattgttgggcgcaatggttctggtaagtctacactgttaaaaattttatctcaaatatatgttcctgaaagagggactgtagctgtggatggtaaattagtttcttttattgaacttggtgttggttttaatccggaactaactggtaaggaaaatgtatacctaaacggtgcgatgttaggatttactgcagaagaaattgatgcaatgtatgatgatattgttgaatttgcggaattaagtgaattcatgaatcaaaagctgaaaaattattctagtggtatgcaggtacgtttagccttttcagttgccattaaagctcaaggagatattctgatacttgatgaggttctagcagtcggtgatgaggcctttcagcgtaaatgtaatgattacttcctagagcgtaaaaaaagtggaaaaacgaccattcttgtcacccatgatatgggagctgtgaaaaagtattgtaataaagctcttcttatagagaaaggatacgtcaaggcattaggagaacctgatgatgtagctaatcaatacagttttgataatgtgcttgcctcaataagtgaagttacagaaaacgaagaacctctgcatcagagtgatattgtaaaagatttgcagattaacctggtctcaaaaaatcaaattgaaccagatgaatcaattgaaatcgagtttagatatacggttttagaagatattgaaacacatgttgcatttacatttttagatttagaacgtcattttgatgtatataacgacaattctatggatttaaaaacgtttggcaaaggcgagaagtttttccgagtgaaatgtaagctaccttcaattaatcaggcaaaattaaaaatggcggtgtcagtacgaaatagtaataagcagccgttattatttgccaagacttctgacacaccagctatttttattagtaggaagtttagtactgataatattgcagaggaagacgcagcgaccgggtttattcagagaaatagccaatgggagctgctagattaataaaatataacggaggcagaatgtcgcgtttgttggtatatgttcactataataaatataatgttgtcagtgaatatatttattatcaattaaagtcgatacgaagtatttattcagacatagtttttgtttctaacagccatgtttcaaaggacatagtacaatatttacagtcggaacgactgattgatttttttatccaaagagataatattggttatgattttgcggcatggaaagaagggctgaatcaagtaacattttatcaatatgattcggtaactctgatgaatgatacatgtttcggccccctctgggacctagaggattattatagtcaatttgacagtgatgttgatgtagatttttgggggatgaccaatcacttagagacaaaaatagatagtgtagttgtcccggaacatttacagtcatattttatggtatttaaaaaacgaatcttgcagagtcaagcatttgttggtttttggtcatcggtaagtgagttaacagatattcaagatgttataaaattatatgagagccaattgacaaaaatacttttatcagagggctatagctataagtgtgcattagatacgtccatttgttgtaaaacccttgaaaatagcaacattacactagaatatccagaagttatacttaaaaataatgttccattcataaaaataaagagttttaccgaatatccagatagaatatactctttattacatcttattaggatgaaaacgaaatatccagttgaattaatcgagaggcatttgaggcagataattattccgggtacgagttttattcctccaatacgggtttcgcaaacgacggagaccgttcgttcttcgacgtcggtacttcttcatattcacatagaatcagtgtctatttttgaagaatacattgaagagttatgcaaaatatctgataggtgtcagttactaataacattgccagaaactgatttttcaaataattttagtatagttgagagatatttgtctacttacaaattgcgagcccaaattgtaaaactcacagatgaattgcatttttttgaaatagtaaacaactatatgggagatgccaaatatcttgctcatataactgttaaacaaacaaataaaacaaaatattctgtagaggatattattgacaggtatcagttgaggaaaatgttttttacatcatttgatgcggtgatttctaattttgaatcacaatctaatttggctgtagttattccagacttaacaaccaatcaaagatatgatagaaaaagtcttcgagagggcaatccagaacttattcgtcaattgaatatactttatgaatcacttgtgagaactaagaaagttgatttttataaagtgccttatataattggagaagaagtaagttggtattggataaaaacagaacactataaaaagattgaggagaaatttagaaacattgatttttcaaaagaagatagattattgctagttccaatattatttatttatagcgcgtgggatttatcaaacgattatgcagtggtcgagaatactgaaaatgtgagtccaatattggaaaagattagtttttctagcgaaagagaattacgtttaattattgaagaaaaggaatttttacaaattggactgagaaggacactaaagataatatctgttgggattgtaagtgtgtttaagatgataaagaaatctctattaaaaaattagggataacggatgacaaacgaggggaagatagtgtgaagagcagaatagtatcaccaaagacaatatttatttggaatttattaggaagtatttcctcagcagcaatatcaatatttttattgttactagtaacacgtttgttgacggaactagaggctgatatttttagttttgcttatgcagtagcaaatctttttgtaatcattgctacttttcaggtaagagattatcaagctactgatgtttcgaaaaagttttcgtttagccagtatcttgcaacaaggcttataacaatcactattatgctattacttgccttaagctatatttttctgtctaaatatgaatttcaaaaatctgtttgtattttcctaatctgtttgtatcgcggaagtgatgctctatcggatgtttttcaaggattgttccaacaaaatgctcggctagatattgcaggtaaatcactttttttgagaaactctattgtgattttgacatttggacttggtttgtttataaccaataacctgctactctcattaatctatctagtaattagttcatatttatttgttttcttttttgatgttacgaatttgtttcaatttacgagggttatcaaagaagaaattaatttgaaagccattaaaaatatattattagaatgtttgccgttatttattaatgcatttttacttgttactatctataatcaacctaaatatgctctcaatactttttttgagagaggtgttataggaacaggtgttcaaagagattttaatattttatttatgcctgttttttcaatgaatattttgttgattttgtttagacccatgataactcagttggctatatatagaagagctggggactataatcaatttaaacaatatcagaagcgtatcgttaaaatggttgtcggattagctgtgttagttttggttgggggaatagtattggggattccagcattaaatattctctacggaacgaatcttaataaatattggctcagctttattataacaatgcttgggggaattgcgagtacctttgcaaccatttgtgataacatgcttactgttttgaggaagcaaaagtatctcgtaatttcatttgcaatttcttgtttattatccatattgatttctaatccattggtagaatattatggaatattgggggcagctattgcttttgttagttcgatgtggacttggtttttaatttctttagtaatatatctaaaattgcaaaaacatttgaattgggaagtacaagaatgaagatagaaaaattatttttaaggttagcaatcccctttttgttaatttcaatatttgttatgcctgtgacaaaggttcctgatgaagcaacacatgcttttatgtcgtggaatatattatttgattctccgacaagtagagatactgaggcaatgaatgaattacgggcagcagattttacgtattcagaaccggagattcatgcagttgattctacagaatattcaagcctttttaccaaaattcgtgatttttcaaaggacaaattatctatcgatttttctctgaaatcgttaatgagtacacctcagctaattggtctagttgtaggtaaattgctttatccgtcatatggtatgatggtcactatagggcgcctttttaatacaatagtctatattataggtatctactatttgataaaaaaaataaagtatgggaagatgaccctgttttttgtctcacttttacctatgatgattcagcaggctggctcactgtcttatgatgtggtgaactatctggctgttgttgcattttttgttttttatgttaacttattggtagacaaggtactgaccaccaggaaatttattaacttaatattactatccttgctactatatctaacaaaagcaaataatattttacttttggcactattgttttttgttgattttgaatttgaaggcgtcttatctaagtttaattcgattttaaaatggattcaaaagagaagattaccaattcttattttagggtttggactagttttacttgttagctatctattcctacataatagaggtggtgtcgtgcactttgtgaaagtgatgataaacagtttatttatcaataatagaaatgatcatcttaatggtattttaacggttggtatttttggttattttggctggtttgtcactcaactacctctctggttaattttcatagatattttcatttttacgttattattatttaatgatggaaatttaaagataagtaaaacagaaggtcttgcgtcgttatttgtactccctgttcaggtagctatcattgtagcgggcatgtattttgcctggacaccgacagctattggaccaaatgcaatgatttctcaaggggcacaaggaagatactttactccgtttttagtctatctatttccggcatgtttaatgttaaaagagcaggtaagtgtatcggtaaaacagaagtatttgatacggttgctcactggcacagtagtcattaactttatcatgtatctatttttgatagtggattattattgggtgtaagaagatagtggaagagggaaacgtgaatatattatttacattgaatgatgcttttgttccgcaagttgcagcttgtatgggctcaatcatgcgaacattagacgaagacgatacatgccatttttatcttttctcagatggtataagtcaacagaataaagaaaaccttcatcaatttgttaccgacggaggaaataaattgacaatcgttgaattggaaaacttggaatcatattttgattttgaagttgacacaaatggttgggcttcggttgtacttgcaagattacttgtagataaattactgcccgaagaagttgatagaatcatctatttagatggagatactttagttttagaaaatattcgggagctatgggaagtagatttggaggggaaagtccttggaatgtgcccagaaccgacagcttcatctgagagaagagaaggcttaaatttgggtacgtatacatatcataatgcgggagttcttctaatcgatttgaaacggtggcgttcaaaaagtataggaacaattatttttgattattataaagaaaaaaatggagagctttttgctaatgatcaagatgcactgaatggagcattgaaagaagagataaaaacactctcaatcacttataattattttaatatttttgatgtttatccatatcgtacgttggaaaaattaagtaggccttcaacgtttatttcaaaagaagaatttgtaaaaattcgtaagcaaccacgtattgttcattttttaggtgaagaacgtccatggagaatcggaaataaacatcgatttagagaggactatgtttctgcattaaatcagacgccatggagaggtactcaatttgagagtggttggcagttttactttttctgttttaatctttttaacatggttatgaagccttttccaatgttgcgttataaaattattacagtcttaattcctgtattcatgaaatataggaaaattagattacaaaaaggagtctaggtgtgaagttttccgttattatcccagcgtacaatgttgctgattatctggaagaatgtgtgtatagtgtactgaatcagacttatgaagagtttgaaatattgttggtagatgacggttctacagatggtaaaacctccaatatatgcgataaattagcagctaaagatgatagggtgaaggtatttcatcaaactaatgggggattatctgcagccagaaatacagggataaagaatgctagtggtgactatattttatttctggatggagatgacttttggaccgatatatgctttttagatgaagttaatagagaaataatttcacatgatgaagttattgatgcagttatctatccattttcctacttttacggtaaggatgatgtagcagttcgaaatttttctaaaaaattaccgtttcatcaggttattacagatacgcgcttactcgttgaaacaggagccctaatcacccctgcttggaataagtgtgtcagaagagataaatttacctctgctcttaatttcttgagtggatatttatatgaagatggtatttggtgtgcaaatctcttgaaagagttgaatgtatttattgttgtagataatacacaatgcatgtatcgtcagaaccgacaaggaagtattacaaataatgtcacgcttcgacatgtagaacatgcctttagaggaattgaagaaaatttaaagaattttaaacaactatcgaatgagaaacaagaagcacttttgatttatttatcaaattcttatatttccatcttgccatttgtatttccatatctgaataattttgatataaaaatgtttgtgaaaaaatttagatatttgctaaaatattcacagaaggtagaacttgtttcgtttagaatctcaggtttaatgaccagagttctggggatatatgtatcaacatttattcaaaacaaacttttgaaaatttataaaagtagataataatagaaagtgattggtaacactgtgaaaaggtggattagaaatttcacaacgcgattatttatcttatcaggtaaatacaagctattgttttatatattagagcttaccaaaaatattgcaaagtttttctggagaattccaaaatatataaagcgaactctactagctttgcaacgtgataagcaacgtagaaataattattcagatatcaaaaatcgttacttgatttacacaatttatgaacatcaatcgtctttacaggactataaagtaatttttttagaggcattggctaaaatttctcgagatgttttaattgttgtaaatggtaaacttccacaggctgatataaatcgtttagcacaatttggtaaggttttggaaagagataatgagggctatgacgttgcggctttccgacacgggataatacatactggaaaagaggcgttacaacaatataatcagctcatcttggttaatgatacgaatattggtccttttagagatttggaagaggttttctctgagtttaattccgatcagctagacttttggggaatttccatgggtgaggagcagctagactttactggttataacccttatggtaaaattcctaagcacttacaatcatattttgttgttattgaaaatagcttgcttaggtatgaaggattttatgattattgggaaaagctctctgatacggattctcgtaataaggcaattggaaaacatgaaactgtgtttgcaaaatatttttatgatcgaggctttaagtatgatgcattgattaaagacacgaaagatagtgcattgtatattcatccgtttaaattattaaaacaaggttgtccattagttaagtattcggcctttagaaattatgacagagaacaatatttttggcatggtttagaaagagaatccgagattccggatttgatggagtatattgctaaggaaacagactatccgatcgaagtggtgtcttctatattagaagattttaaaactagagaaaatcaatcttatattttgattattgatggtgtcgaaaatattattccacaatgtacacgttatcgtgtgttaaataaggctgagcaattgcgagaacttggttatacagttcgagtgataaataattctcttgtacaacttcaggatgcacagtttgctagtcatattattatttatcgtgctccattcaatgatatgctgaaagaaatatgtagggcagcacacataaagaacagacctgtttattttgatattgatgatttggtttttgatacaaaatttacagatgaacttgaatttacccaaggtttgagcaagagagagaaaaaaggctatgatacaagtgttttagcttacaaaaaaatgctttctctctgcgattatgctatcacatcgacttcgaaattgaaagacgagctcgaacaatataaaaacaaggttattttgaatcgcaacgtcatgtctaaagaattagttgagcgtagtttacaagttaagaaaaattcgaacgacaataaagttaaaataggatatttctcagggtcaattacacacaacgaaaattttgatttaattagtcaagcattgctaaatctacttcaaaagtacccgcaagtggaattacatatagtaggatatttagacattccgaaaccattccaaaaattcaaaaaacagattgtgagtcatgagtatgttgattggagaaagcttccaattttaatttcacaagttgatattaacttggcgccgcttgtaaccacaacctttaatgaagcaaagtcggaaattaaatggatagaagcggcagcagttaaagttgtgacagttgcaagtaatcttggagcatttgaagagatgattcaagatggagtgactggagttctagcagatgataacgaatgggaaagtaaattggagagattgattcttgaacaagacttgagagcacaaatagcagaaaatgcttttgagtttgtaatgaatcattgcactacagcaaatagaattaatgattttttgaaagaagagttagtctaatgaaacgtattttgtttatttctcctacgactagtatggataatggtgcggagaagtctatttattatctaatgaagtaccttattcaactgggacacacagttataaatgttactcatgcaataggaggggaaccacaagataagcatgagcaactttataaaatgataggggttaagaattactatttgccaactattaagtggtggtggccggatgcaccaggtggagaaatccttaatagagaagaggccacaagctactatcgccagaatgttcaagacatagctgaaattattgagcaaaatgagatagacttggttatttcaaatactgttaatgtttttcaaggagcaattgctgcctcatgtcaaaaggttcctcatttctggctaattcatgaatttcctaaaaatgagtttgcttattatgctgataaaattgacttcatagaagagtattcttcagaattatttagtgtgactggagagttaaataattttttaacaccactatttaataagaaagtccattcgtttatttcttatactgagcaagaaacaaaagttttaaaaaaaggcaatcaagttagaattgtttctgttggtcgattaacagaaggaaaaaatcaattagaacttataaaagcatataagacactaaatagattagacattgaattggtttttattggaggatgggatagtaaatacaaagctatttgtgatgaatatatccatgaaaataaattacagaaaaatgttaaatttttaggtaacttagataatccttgggaggaagtaactgatagagatatctgtgttttcccctcatctatggaaacttttggcttagtctatgttgaagcaatcttaagagggcttccagtaattctatcaaataatttgggacatttgacggcatttgaaatattctcagcaggtcaaatttataaattgggcgatatagaagagttggtgactaagttagagcaagtgattgaatcctttagaaatttttcagatagggctcggcttgatgtggaacgtttacgtactctatatacaccggaagttgcctataaagaaatactggacggcatcaatcacttagaatatactggacaccaaaatacaaatttaagtcacataaaagagttactgactttaaatatgcgtccaacaagattggagcgttatgcaagattgatcagcaatatggcgacaaaaatcagacataaacttcgactttaatgaataataggatagctatgctgaaagatgtatattatagtttcttcaaatgagtaagtagaatctaaaaagttatatagaattctagttttagagagaaaaaatgaaagtattaatgattatccctgcctacaatgaagaagaaagtatccttcaaactgttcagggaattatagattataaaaatagtgtgaatttccaattggattatgttgtcatcaatgatggttcaacagatagcacgaaagaaattttgattcaaaataaattaaatgctgttcatctagtacaaaatttaggtattggtggagctgttcagacgggatataaatatgccttggacaatgactatgacgtagcagttcaatttgatggtgatggtcagcatgacattcgttcattaaatggcttaattcagccaatcttagttggtcaggctgatatggtgattggctcacgctttgttggtgatactttgtcggaatttcaaactagctttatgagacgatttgggataggtgttatttcaaatatgattaaattaacaactggaaaccgaatttgggatactacatcaggttatcgtttgggaaatagaaaagtgattgcacaatttgcaaaacgatacccaattaaatatccggaaccggaatcaactgttcatttactaaagcaaaatttccaagtagtagaagcaccggccaatatgtttgaaagagcgggaggggtttcttcgattactccatttaagtccatccgctacatggtagaagtttgctcatctattttgattgcttcgcttatgaaggagggggaataatgactatacaagcattagctatgtttcttgcctcgctaggttttttgtattttatttttaggaatattaataaaaataagatcttattcgaacatgcctttatgtggattgttattggcttcggactgattgtttttgcactctttgatgttattcctattaaattggcctacttattcgggtttggtctgacttccaatttcttgttatctgtggcaatttttgttctcttggtaattggatttttgcatagtatggctttatctcaacaaaagcagcagattaaaaatttaattcaagaagtatcaatggctaaaaaaagaatctctgaattggaggagcatcatgcagaataaccatacatttgttatctgtgcttatggagatagtaagtatctagaagaatgcatccattcgttaaagcagcaaacacttcaatcacaactcatcctatacactagtactccgagtgaatatatagaacaaatttgccaaaagaatgcaatcgtaatgcataccgcacaaggaggaggtattggaaaagattggaatttggcactctcttttgtaacaaccccttatgctacaattgctcatcaagatgatatttatttaccagactattgtgaaaaaataatgtctcagatgacagaggaaacgttgattgcttattcagattaccaggaagttaaggaaggtgtggctattcccttaacttcaaatttgaaaatcaagcaactcatgttacggacaatggccatgtttcccaaatggaagttttggcggaatagggttttagcctttggtaatccaatttcttgtccagctgtgacctataatttgaagaaactgaatgatttcaagtttaatgaagaaatgaaagtttctcttgattggtttgcttggtatcagattgcacaaaaaaatgggagctttacctttgtagatgagagtttgatgtatcatcgtatccatgaggaatctgagacgacaaatagcattgaaaacaatattcgtacacaagaagactatgaaatgtatttgttgttctggccaaagtttattgccaagtttctcctgagttactatgttaagagtcaagagacgaataattaaaatattttagttaccaatcattgtattcccatcaattcctactcaaaatatttcaaaaacatttcagaaaaattacaaaacattcaacattgtcatgtaaatgtaataaaaaatttcaaaagatagaggttttcataggaaaatctctttttttgtgctagaataatagatggaggtccgatatgatcaaaatttttggtaaaattcgttaccattggcaaccggatttatcatgggccatcatatactggtcacttaccttcacacctatttttattggtatggcacttttattggagaagttgcaagtttcaagattatttattctacttgtctcactctttgctgtattagtagtgctcggcttacatcgctatttcgagataaaagatgagcatttacggattgcttcggctaatccttttgcagtgcagaaaattgaaattgctaccatagaaaaaattgaagtttcttatttagccattcgtatatttgcaaaagaatttcccaacggacgaatgtattatatgcgtaaatggacaaaaaaatactttattaaccatttagctattcatagttgcttcaagggtaaaattgaattaatagaccatttaataaaacaggattattttgaagagtattatacaaaaaaagccaaatcaatccgctgaaatggcttttgtaggacatgatttgatggctttgagaatatctggattgggttcaatcgttttctcaaattgtgagtcgtctgaaaaaacaacgataccgtcgtcatcataatcgaatagagatgagtaggtttggcagagcccgcaagcaatgcaccgttcaggaataagttttactttcatattagtattgtaatcatattttaataaaaatacaaggagttttctcaataatgtcacaagagccatggaatgaagaagtttaccacacagaaacaactagtcgtaaagaacgtttgagtaagggggtagcgaatacaacagtatttacagttttggcaattattttctttgttatcgtactgattattggaattatggctgtctatctctcaatcggtggcggtagtaaaacagattcaacaaaagaattttataccccaagcactacaacagtcgtagcagagagctcttcatcggctgctgagacacaagaatctacttcgactgacacgacagaaacagaaacaagttctagcccagcggaagcaacggatggctctacccttactgttcaagcaggtgaaggtgtaggacaactggctgctcgtggtgggatttcaattgcagagctagagcgtttgaatccagagaaaatgactacagggtcttggattgctcatcctggggatgtagttcgtattagataaagaggagttatgaaatcaattcaaattgcaattgacggtccagcttcaagtggaaagtcaacggtcgctaaaattattgctaaaaatttgggatatacttacttagatacaggagctatgtatcgctcggctacctatctagccttgacaaacggcatagagatcacagatcaaaatagaatcgtggacttgcttgcccagtatcccattcgatttgggcgggatgaaaacggtcagcaacttgtttttgtcggtgatgaggatgttactttgcctattcgagataatcaagtaacaaataatgtatcagcggtagcagcgcttcctctagtacgggaagaattggtccgcctgcaacaggacattgcgcaagctggtgggattgttatggatggtcgtgatattggtacggttgtattgccgcaagcagaactcaaaatattccttgttgcctctgttgaagagcgtgcccttcgtcgatttaaggaaaatacggaacgtggcattgagacagacttggaatccttgaaagaggagattgcggctcgtgactataaagattccaatcgagaagtttctcctttaaaggcagcagatgatgctattacctttgatacaacaggagtatctatcgaaggtgtagtgaaatttatttccgaaaaagcgaaagaaattcttgacaggtagctttagacatgttagaatagtcgtattgagaaaagcagaagtgagaacttctcgccttgcgactaacgttgtctggctctacggattaagatttcttcggaaagaataatggtgtagtgcggacttgtttagcaagtccgtttcgtttttctcgaaaaatataaaatgaggtgaaaagccatagcaaagcaagatttgttcatcaatgatgaaatccgagtgcgtgaagttcgtcttatcggtcttgagggtgaacagttggggatcaaaccactcaatgaggctcaggccattgctgatagcgccaacgtggatttagtattgattcaaccccaagctaaaccaccagtagcgaaaattatggactacggtaagttcaaatttgaatatcagaagaaacagaaagaacaacgcaaaaaacaaagtgttgtcactgtaaaagaagtgcgtctaagtccagttattgataaaggggatttcgagacaaaacttcgtcatgcccgtaaatttcttgaaaaaggaaataaagttaaggtttcgatccgtttcaagggtcgtatgattacccacaaagaagttggagcgaaagtattagctgagttcgctgaagcaacccaagatattgccattatcgaacaacgcgctaagatggacggacgtcaaatgtttatgcaattggccccagcttcagataaaaaataagctttttaagcaaaaggagaattaacatgccaaaacaaaaaactcaccgcgcatcagctaaacgtttcaaacgtacaggttctggtggattgaaacgcttccgcgcttatacttcacaccgtttccacggtaaaactaaaaaacaacgtcgtcaccttcgtaaagcaggtatggtacatgctggtgacttcaagcgtatcaaatcaatgcttacaggtttgaaataagccgacttactagaatttagattatcatttggaggaaaattaaatggcacgtgttaaaggtggcgttgtttctcgtaaacgccgtaaacgtattttaaaattagctaaaggttactacggagctaaacatctcttgttccgcactgcgaaagaacaagtcatgaactcttactactatgcataccgtgaccgccgtcagaaaaaacgtgatttccgtaaattgtggatcactcgtatcaatgcggctgctcgtatgaacggtttgtcatactcacaattgatgcacggtttgaaattggccgaaatcgaagtaaaccgcaaaatgcttgctgacttggcagtgaacgatgcagcagctttcacagctcttgcagatgctgctaaagcaaaacttgctaaataagtataaaaatgtaaagaacttggtagtgatgaaccaggttctttatttttggaaagtagctcactacttgctaaatttcgatatgagtgatatacttaactagtaaataaatcgacggttttaactttatcgtcatttagttttgcttttgttacttcatcaactcgccttgcctaacttcagttatgcctgcggctcattgcctcgtactaaaagtaaactaaaagactataataagtggatgtggtgatgctattttacaatagttgattacatttatcgtgtcggtaatataataatggtaaataaggagagaaacatagatatgaaacaaggtaagactttgctttatgtagcaggagcatcgcttatttgtgctgtagcattggttacttatcaagcgtctaactatagagagcaatcgaaccatcaaaaaacaacaagcatagaaacatcgcaatcaaagcaatcaaaagagattccttcagattcgaaaaaggaagttccagggattgataaggcgacggatgatggttttttactcactgatgagtcacaaattgaggaaaaaactgatttaggaattattgtcaatcatggcgatcataagcactttttcttttattcagatttaaagaatacaaaatgggcttatttaattcctgaaaactatcaagaaaaaaatcattcttctcaacctaagagaagtcaattatcgtcaggctcgaaacagatcgaagatgaatacgtttttgatcctaaagatattgtcgcagaggatgccaatggctatactgttcggcatggggatcattatcactatattttaaaatcaagcttaggtggcacgacacacagacaattgacctctgatagtcgtcaatcgccaactcttcctatcgttcaccaacaggaagggattccggggattgattttcaaacgagtgacggtttcttgtttgatgggcaaaatatcagcggtgtaacggaaaccgggattctagtaaggcatgggaaacatttgcatcttattcattttgaaacattgaaaaggagtaaatggtcttatcttgtgaatcagtataaaccaaatgttgaatcggataagaaggcacaacctgaggtagaaaatactgagtatcaaaccaaattggactacttagcaaaagaactgaatttagagccatcacgttttaagaaagtcatcgttgacggtcaaattggattagagtatccgcatggagatcacacacatattgttttattaaaggaaattgatacaacgaagccatttgaaagtccggaagatcgtattcttaaacaaaaggatggagaaactcttgaacagagaaaagaacgtctcattaaacagtacatggagcgttttaaagtaaaacgtgaggacattacaattgatgggaactatatgagtgtacgccatggagaccatgcgcacgtttataaaattgatcctagtttgccagatgatcctgagcgtgatgttaagactgaaacggtaaatcttgctattgagaaacaattagtatatggacctttttatacagaaggttcaacagaaaatttaacacgtaatggtgtccatcaaaagtatcgtccagaaggtcttcaggatattaaaaatttcattctagtaacattcagtacaaatagtgattttggtaattttgtcgttaatggtaaaaaaacgaagagagtttattatttggttcgtaaagatttaaattgggaggatttgaacatcgcctatccgcagacccttcaacaaaagggacgcgtctttaacggttggaatgctactttgccaaagtctggcaagatggcaagagaacatcaaagtttttatgctgattttgataatgtttatcgtaagccaaccaaaaatatttacactccaagtgatgatgtttcaaatattgatttatcagactatgtacctgttaaatatagtgcgatagccaatggtcgtttaaaattaaatggtgagattcgagcagggttcatatactttgtgaaatctgacttaacttggaaacaagctaaggagcaaggacttgttgtaccagaaccggtttcaagcaaagattatgagttcattgagtttaggacagttattactggtggagaaaaagatacagattatgttagtgccacaacgagcttggcagcatttgggacaacggctcctcgtataggaccttacattgctaacaatacggagaatccaacggacatcaatgacccaagtagacatccaaattactattggcatgatccaaagaattatgtagccctcgcatttcgagcaggtgaaggtggtcaacttcagacacatttgggaactagtaaaacagttgtttaccttgttagaaaagggttaacactgaaccaagctggaatttttccgccatctttgaagagtgatacaggttataaacgagattatacaaaacctgttattccaaatgtagcatgggatacacctattttggaagatactgtctacgatattcatttcgataaagttgaaagtgatagcaaagatgggacagttgagccaggtgatacttggttgcctgggaatccattggcgaatactccagatgtccctaatggagaagaggacgcagatagctggttagatgatttgttgacacctagtccagaagcgacagatatagaaactgtaacagaagctgaaactacaacagaagatacaaaagcaactgaaagtagtactgctgctcccatagatatccctaaaaaatcatcaacagaggaagagcctagtgaggattttatatttccttgatgaaatagatatgagtgatttgaaatagtggtctaatactcttcgaaaatcaaaatcagacgttgttgacttgatttgatgaacttcagttctatctgcatctgcgtcgcctagtctgtttttgattttcattgagtataaaaaggcttagaatcaatgtagtaactgacatgattctaagccttttatagtgtattaccgtgaatttgaactggtacttgttgagctagtgcttgtaccagtatttggtgtactggtagcagttgtactaccgtgaagttctaggtagcttggtgctttaaatagttcaattgttgatttattgccgtttgtgctatacaaacttgttgattgtttgccaagtttattctctagtgcaatctcggcagccaatgagtcaatgtagttatattggcttggatccaaggctggcaatccattgtcgaagaaccggataagatcaccagtttgaatggcatcgctagtcgccagttgtgctgcagtagcttctttaattgcatcaatttctttctgagttgtctcatctggatttgtaatttcaagaccagtttctgtataatagattttaccttcgtagctagtgtattttggtgtgataaaactgccagcagttcgaagagccacaatttggctgtgttggctggaaagtaggtcttgaccaacttgaagatagttatcggatttgattcctaaaagatgttcgagagtgggaagtgcatcaatctcaccaccataggtatcaaaaatcccaccgttggtcattccaggtacaacaatcatatatggaacacgttgcatcatggcattgtcaaaatctgaccaagtctgagaatcttttccaatcaacggtgccaagtcaggattacgtgaattagaaattccatagtgatcaccatagaggacgatgatggagttttcgtacaagccagtcgcttttaagtaatcgaaaaatgcctttatggacgcatcgagatagttggcagtagcaaaatagccattaatggtttcatcatctgtattggctaatggaaagccaatctcatccccaatcaagctggttgtataggggtagtggttggaaactgtgataaatttggtatagaagggttgctgtaaatgttccagatattggatagagtcggcgaacatgattttatcattcagaccgtattggaatgaattttcagcagtggctttagagaaataggattgatcaaagaagtaattgtaaccccattgtttataggtgttgttcctattccagaaactggctgcattaccgtggaatacagcagatgtatatcctccattttgagagagaatatatggtgcagcttgttgggtattgcttccgccatattggaccatgaaagagccttgattgagtccaaaaagagaggtttcaatcatggtttcggcatcagaggtcttacctgccttaacttggttaaagaaattggaaaaggcaagagtagagctagaatgatacagagaattgaggaaaggtgtgacttcgtgctcgacaccgttgacattcaacttatagtcaataacaaattgttgtaagctttctaggtggagatagataacatttcgccctttggcaataccgaagtagttgtcattcggttgagcataatgttctgtaatatattgtttcacaggctccaaatctgtagctgatgctccagaacgattcttgtgggcattgtaggtttgattagcattgtaaccaaggaaagcaggtaaaccaagggctctgacgatataagtattagaaaatcctctcgtaagtagctctggtctatcaatttctgctaaaaagaggttgatggagaaaagcatgactgatagtgctgtaatagcaaagctagattttttatgaaatgtttttttatcccaccggagtagtttacgatagactaggattccaaaaatgataaaatcaagaaaatagacaatatcccatagcctaaataacttaagagctgcttctcctaatccagcagatacactagaggtagccattatagtagagatggaaatataatcggaaaattctctgtaatagactgcatttgaaaagagccagacggaaagaataatataaatgatcatcgctacgctatagaagacttttgtattctttatataaagcgagagaccgagtaataaaatcccgactggtagaggattcataatagcaataaaattttggaaaaacccttgtgtatctaagttgaaatcaacatagtaggcccagagtgttttgagccagtaaatgattagcaaaatcaagacgaaaccaagtctagtctgtccgctcttcttgacatagtcaattagttttttcacaataaaacctcatggtcctttctaaaagtttagttcattataccataattctaaaataagcctcaaagtttagagtttttttggcatatatgaagaaacatgttataataattctatgaaaataaaggtaaaccgtattgcagaacagaaaataaacagagggattcaactcttggatagcgctgatttttcaggtgtttcatttgatgaagacaggctggctgttttgtattcagagtctggaagctatttgggtcaggcttatttgtccaaacagaataaggggataggctggctgtttagtagaagcaatcaagacttgaccatggatttttttgttaaattattcgtggatgctaaacagaaacgtcaacatttttatcaatctgagatgacgaacgcttttcgtttatttaatcaagatggagatagttttggtggaatgacggttgacttgtatgatgaatacgcagttttttcatggtataatacctttatttattctgtcaaagagatgattgttgctgcatttcaacaggtatttccagaagtaagaggagcttatgagaagattcgttttaaaggtttggcctttgagtctgctcatctttatggagaagaagcccctgagtatttcactgtgttggaaaatggagttcactatcaggtctttatgaatgatggactgatgacgggaatctttttggatcagcatgaggtacgtggttccttggtggatggcctggcggcaggcaagtcacttttgaacatgttctcgtatacggcagcattttctattgctgctgccatgggcggagcagaggaaacgacttctgttgacttagccaaacgctcgcgagaactttctaaagctcactttaaggttaatagtttagacttagataatcaccactttgtagtaatggatgtatttgaatatttcaaatatgccaaacgtaaaggcttaacttatgatgtgattgtcttggatccgccaagctttgcacgaaataagaaacaaaccttttcagtagccaaagattatcacaagttgatttctcaatctttggaaatactaaatacaggtggaactattatcgcttcgaccaacgccgcaaatgtttctgttgaaaaatttaagcggcagattgaaaaagggtttgatgttagaaaacatcgctatgaggcaacttatcgcttgccagccgattttgtaatcaataaaaatgatgaaagtagtaattacctaaaggtctttacgatacaggtagataaatgaaaatagtagttcctattatgcctagaaatctggaagaggtagaggccattgatgtagaacgtttagcagaggcagatattgttgaatggcgagcagactatcttctgaaagatgatattttaagagtagcacctgctatatttgaaaaatgtagtggtaaggaagtagttttcaccattcggacaacacgtgaaggcggtcacttggatttggacgatcaagaatatgtcaatgtaatcaaagaagtagcaacgctttatcagccagattatattgattttgaatactactcttataagtcggtttttgagcagatgttggagtttcctaatcttgtgttgagttatcataattttgaagaaacaccgtctaattatatggaaatcatgtctgaactgactagcctatcaccagctgttgttaaaatggctgtaatggctaagacagagcaggatgtcctagatgttatgaattatactcgtggttttaaatcactgaacactgagcagatatttgcgacaatcgccatgggtgaactagggaagttaacacgtattgcaggtgtgattacaggctcctgctggacttttgccagcttagatgaaacatctgcaccaggacaaatgtctttaagcaatactcgtaagtttctggaaattttggagaattaagttatgcgttatttaacagctggtgagtctcatggaccacgtctaacagccattattgagggagttccagcgggtcttcctttaactgccgaggatattaatgaagagttaaaacggcgccaaggtggatacggtcgtggtagtcgtatgcagattgaaacagatcgcgtagagattacagctggtgttcgtcacggtaagacaaccggtgccccgattacattgaatgtgaccaacaaagaccatcaaaaatggttggatattatggcagttgaggacatcgaagagaaactcaaaagtaagcgtcgtatcaaacatccacgaccaggacatgctgacctagttggtggtatgaaatatcgctttgatgatttgcgtaattccttggagcgttctagtgcgcgtgagacaactatgcgtgtggctgttggtgcggttgccaaacggattttggctgagttggatattgaaattgctaaccatgtagtcgttttcggagggaaggaaattgatgtcccagatggtttaagcgtagcagaaatcaaagagcgtgcagcccagtcagaagtatccattgtcaaccaagagcgtgaagaagaaatcaaagcctatattgatcaaatcaagcgagatggagatactattggcggagtgattgagactgttgttggaggagttccagctggcttggggtcttatgtgcaatgggataaaaagttagatgcaaaattagcgcaggctgttgtttcaatcaatgcttttaagggagtagaatttggagtaggcttccaagctggttatctcaaagggagccaagtcatggacgaaattctctggtcccaagaaaaaggatatacacgccgaaccaataatctaggtggttttgaaggtggtatgaccaatggcgaggccctaatcattcgtggtgttatgaaaccaattccgaccctctataagccattgatgtcggttgacattgatactcatgagccttataaagctactgtggaacgttcagatccaacggctctcccagcagctggtgtagtcatggaatcagtcgtagctacaactctagcgacagaaatcctagagaagttctcttccgataatatggaggaattgaaagctgcggtagccagtcatcgcgactatgtcaaaaatttctaggtaattaatgaaaaaaacgattttaattgtaggtctagggttgattggaagttcacttgcgctctgtattcgcaaagaccatccagactatcacctcattggctttgatcctaacgaacaatcatgccaaattgccttgggcaaggggatggttgatgaggtatcaacggaattggagggtgtagcaaagcaggctgatgtgattcttctttgtgttccaattcaagtttctttgcgtttgattgaagaatttagtgcccttgaattgaaggatacggtcttgattacagatgcaggttcaacgaagtctgcaattgtggctgctgctgaggaacatttggcgccaagacaaattaattttatcggtggacaccctatggcaggtagtcataaatctggtgccagtgcagcagatctccatctatttgagaatgcttactacattatgacaccgtgtcaggctaccaagcaggatgcggttccccgattgacagacttgttatctggaacgggggcacgttttgttcagattgatgcagcagaacatgaccgtgtgaccagtcaaatttcacattttccacacgtattggcttctagtttgatgcatcaagctggtgagtatgctcaagatcatccctttacgaataattttgcagctggaggatttagagatatgacacggattgcggaaagtgagccgagcatgtggactagcattttgctaaccaatgcagattctattctaaatcgaatcgaggaatttcaagcacgtctttcagaaatttcagatgttctcagatctggcgatcaaaaagcaatttgggacttttttgataagggacgtcaaactcgtaaagccatggaaattcacaagcgtgcaggtgttgattctttctacgatttattccttagtgttcctgatgaggaagatacgattttgaaggttttggaagtcttacggggtatttccattgtcaatattcgtatcaatgaagagaaccgtgaagatatacacggtattttacaaatcacgcttaaaaacaagggaaatttggaagacgctgcgaaacgtttaagagagcagacgacttacaaaatccatttagattaggagaaaaatatgtcaacaaatatctatgatatcgcaaatgaattggaacgtgcaatccgtaacctgcctgaatataaggcggtggaagccgttaaggtctcagttgaggggaattcagaagccaaagaaatattggaaagttatatttctttccaaaaagagatccaatctaaattgcaggctggtgaaattcctactgaagctgaccaaaagaaaatgttggatttcaacaagaaagttcagggaaatccacttttgacggaatatttcagcaagcaacaacagttgggaacttatgtagctgatttggaacgtatcatcttcaagcctctcaacgaattgttgtaatatatttatatttgataggagcagggtgttaggtcatggattgacgcctagtatacactgcttacgtagagttcttatctccaagtacagattcagaaacggtacttagggcagtaagaactcttttttctaccttctcacagcatccatttcttataaagttatggtaattacttgacattttctaatagaagttctacaatatatttagtatatggttataaccagtttgataagtatatatatcaataaaggagataatatgacagtatttataaaagcaaaatctattattttaccagagagtgaggtcgaatcagcctatttggaaattactgacaagggtcagtttggacggattgtgattgaaaagcctgaaggggagattgttgattattctgactttcatttagcaccagggctagttgatacacatatccacggctacgcttctcacgatgttatggacaatgattttgaagggatcaaggtaatttcagaaggtctcttgtcttgtggggtgacctcttggcttccaacgacattaacagatacgactgaaaatttagatgcagtttgtgaaacgattgggacttatgcagggcaggaaacaggcgccaagattcaaggtattttcttagaaggtcctttctttacagaaaaatacaagggagcacaaaatcctaagtgcatgagcgatccatccattgaaaagttagacaattggcacagcttatctaaaggtttagtcaataaaattgctattgctccagaacgtgaaggcgtcaaagaattcatcgagtttgctaacagcaaggcaattcatactgccttggctcacagcgatgcgacctatgcgcaagcggaagcggcagtagaagctggtgccaatatcttcgtccatgtttacaatgggatgagtgggcttcatcaccgtgaaccaggtatggtcggtgctgctttgaatttaaaaaatgtctatgcggaaatgatttgtgatggacaccatgttcatccagctgcggcagaaatcgtggtcaaagcacgtggagctgaggaaactgttttgattacggactgtatgcgagctggcggtatgggtgaaggggagtcccgcctcggtgaatttgaagttgttgtaaaagatggaactgctcgtttaaaagaaagtggtagtttggcaggttctatcttagaattgattgaagcagtgcagaatgttgtgaaatggggcttggtatccctacctgatgcccttcgtatggcttctctggcaccagctcgctctgtcaatattgaccatatttgtggtcggattgcagaaggccgagctgcagactttatcgtcgtagatgatgcaggacgcttacaagcgacctatctagatggcgtgaaacgatttggttaataaaatccttaggaggaaactaatgacaaaattacaactttctcaggctaaattcaatcacatgactcgcttgtcaaacagcgatcaggtgattgcggctttggcgattgaccaacggggggctttgaaacgcttgcttgctgctgcagcaggtggtggcgaatttggagatgacattttgattgacttcaagaaagtcatctcaagcgatttgactccttatgcaagctccattctcttggatgcggaatacggcgttccggcttcagaattgcgccatgcagattgcggtttcattgcagcttatgaaaaaacaggttacgatgcgtctacaccaggtcgtttgccagaccttttgccaaattggtcagccaaacgtatcaaagaattgggtgcagatgccgtaaaaatcttgctttactatgatgtagatgacaagccagaaatcaacgacattaagcatgcttgggtagaacgcattggtagtgagtgtatcgcagaagatattccttacttcgtcgaaatcttgacttacgatgccagcgatatggatgtgacttctcgtgaatacgcagccctcaaaccacacaaggtcaatggtgccatgcgtgaatttagtaagtcacgttataatgccgacgtgctcaaggttgaagtacctgtcaatatgaactttgtagaaggttacacagatgaagagccagtctatacagttgaggaagctaaggccttcttcaaggaacaaacagatagcactcacttgccattcatttatttgagcgctggcgtatctgctaaacttttccaagaaacccttgtctttgccaaagaagctggttcaagctttaatggtgttctttgtggtcgggcgacttggaaggatgcagtagccatctttgcaagcgagggtgaagaagcagccaaagcttggttggcggatcaaggccgccgcaacgtagaagaactaaacgaggttctagcaattacagcgcgtccttggactgaaaaagttgaagtaaaataattgttttagtagggtctgggcttaggttcagactttttgtaacatcaaatatagtcatttatactcttcgaaaatcaaaatcagtcgatgttgacctggttttgcaatccgctcttatatctctcaccttgaacagtccatttactgtgcaagcaatcccagaaacagttatagctgcggttgttgacgcaaaccttgttccccttatttccaacctctgactatttgtgaaatagttggagcaagtactaaaagtaaactaaaaggctatataaacaagatgacaggtcgttttatagctaataatataggggtctatttttagaaaaattcgaaaaaacttgaaaaatctgaaaatttacgcaattccctattgacaaataatttgaaaacagttatgatagttacaaataaatgagaaagggaaacagagatgttacaaatgtgtcaaaatcattcagctaatcatacttatttctacggctattttagatagtgtttgtagacatggtaaacatggatgcaaacacgggaacgtaaagtttgtatctatgtggctgtagctattttgacatgtgcctcatagatgatacatctaaatggcacggataattcattctgttttcctatacagatgaaatataaggaccgtttagagtgtagtctaagcggtcctttcttgtttgctattatatttataaaaggagaataatcatgggatttaaaaaaattatacttagttcagtagcacttttgtcagcagtaacgcttgctgcatgtagttccaattcgtcagattcaagttcagtcaatgttggtattattcaatatgctgaacatgaagcgttgagctcagctcgtgaaggctttgtagaggcgctcgaagaagcaggctacaaggaaggtgaaaatctgacgattgatttgcaaaatgctcaaggtgatcaagcaaacttacagacaatggttgagaaattggcaggaaaaaatgatcttaactttgccatcgcaacaccggcagcccaaaccatgcttaatgcagatagtgaaacatcaagtgtattcacagctgtcacagatccagttgaagcaggtttggttgaatcattggaaaaaccaggtgggaccatgacgggatcgattgatgcaactgatgtggaaggtcaaatcgagatgttgctcaaagttgtaccaactgcgaagactgtcggtattttctacaattctagcgaggtaaactcagaagttcaagctgagcaggctaaaaaagcactcgaagcaaaaggtgtaaaagtagaagtgacaacagttacgacgacaaacgatgttcagcaagctattacttcacttgcaggaaaagtcgatgctatctatcttccaactgataatacagttgcctctacagcttcaacaatcggtgatattttaaaagaagcaaaagttccagctatgggaagtgacgcggcagttattgacgcagctctatttacctacggtgtcgactaccatgctatcggtgttcaagctggtgaattggctgtgaagattttgaagggtgaaaagcctgctgacttagcagttgaaaaaccaaatacagcggctattaccgtcaatgaagaaatggctaaagctgttggtattgatgcagcgactataaaagcattagaagagtaaaatatttaggagaagaaacgtttatgtattataagctagtaaaaaaattggcaactatttcagtagcaagtatgggtttgctaacacttgcagcttgttcctcatcatcagaacaagcttcctcagatgtggtaaaagttggagttctccaatatatggagcatgaatcattgacagctgcccgtgagggttttgtggcggaattagaagcaaatggttataaagagggtgaaaaattggttttggattatcaaaatgcccaaggcgatcaagctaaccttcaaaccatttcagaacaattaatcgatggaaatgatattgtcttggcaatcgctacgccgtctgcccagagtttagcgactgtgtctactgaaacgccgattgtctttactgcggttacagatcccttgtcagctgacttggtagaatccattgaaaaaccaggtggacttttgacaggtacatctgatcaagctccaattgacaaacaggttgaattgctaggacaagctgttcctgatgctaagaccgttggtattttgtacactactagcgaacggaattcagaagtccaggtagagcaagctaaggaattgctagaaaaagcaggttataaggtagtagtaaaaggaatcacatcttcaaatgaagtccaagatgcgacaactagcttgatgaaggatgtagatgctctctttattccaacagacaatactgtcgcttcaaccatgaccatgattggtgaattatctgtggagcataaggttccagtaatcggtggttcaacggacatggtggatgaaggaggtcttttgacttacggtaccaactatgaagctttaggtcgtcaaactgcaaaaatggctattaagattatcgaaggagccaatgtgtcagaaacggcagtagaatacccagagaccgtcagtcttcacgttaatgaagaaatggctcagaaattaggtatcgatacttctaagcttgctgtatctgaataagatcggtaagatagaacctagtattgactacgaatttagaaaaaggagaaaatcgtggatattattttatcaagtatctcgcaaggcttgctttggtcagttatggcgattggtgtttacttgacgtttcgtattttagatattgctgatatgacagctgagggatcttatccgcttggagctgctgtttgtgcgacagggattgtgaacggagtgaatcccttgctggcaacctttatggctatggtagctggtatgggtgcaggcttgatttctggtttacttcatacaaaactaaaaattccagcccttttgaccggtattgttaccttgacaggactctactccatcaacttgaaaatcttaggcaaagccaatgtggctctgcttaagcaagaaactctagtgacccaattgcaggattttggtttgacaaaaacaaatgctgttttggtgattggtctggtctttgtactagcagttgtaggcttattgacgctcttgctcaatacacaaattggtctagctattcgttcaacaggggataatattccaatgagtgaggccaatggtatcaatgtagataatatgaaaatctacggttatatgttgtcgaatggtctaattgccctttgtggtgctcttcttactcagaataatggctatgcggatttgaactctggtacaggtaccattgttatcggtctagcatctgtcattattgcagaagttatcttgcgtaacttacgcttgggttggagactcctatcggttgttctcggtgcagttgtttaccgtttgattatcttagcgattttggaaattccaggtatggatgcagaccttgttaaactcttctcagctatccttctggcaaccgttctctatgtgccagaattgcagaagaaattgaatattcgtcgtccaaaattgaatggaaatgcttaggaggaagtcatgtctacaattttatcaatccaaaatattcataaaaccttcgaagctggaacagttaatgagaaccatgtccttcgtgggttgaacttagatgtaaaagaaggtgattttatctctatcatcggtggtaatggtgctggtaaatcaactttcatgaactcacttgcaggtgccttgacggttgattcgggcgatattttgcttgaaggtaaatccattaagtatgtctcagctgccaaacgctctaaggacatcagccgtgttttccaagatcctaagatgggaacagcttctcgcttgaccattgaagaaaatatggctattgcctatcgtcgtggattgtcacgtggtcttggctggggggtcaaagatagtgaacgtgctatttttaaggaagccttgaaagagctcggtctgggactagaaaaccgtatgaaggtggacacgcaatttctttcaggtggtcaacgtcaggctctgaccttgatgatggcttcgctggttaaaccaaaagttctgctcctggacgaacacactgcggcccttgatccaaaaaccagcgatatggttatggaattgaccaagaaaatcgtggaaagtcatcagttgacagctctgatgattacgcataatatggaaaacgccattgaatatggtaatcgtttggtcatgttgcaccgtggtcagattgttgtcgatgtagaaggagaagagaagaagaacttgactgttcaaaacttgatggaccttttctacaaaaacagcggtgaaaagctaactgacgatgagatgattttataaaaaaataagactactgatttcatgcaagtcagtagtcttttttcttatatcgtcatttatactcttcgaaaatcaaaatcagacgttgttgacttaatttgatgaacttcagttctatctgcatctgcgtcgcctagtctgtttttgattttcattgagtattagttgacttttattacttcgacgtaaaagtcaactaaatgactatacttgtagaaattctagcatttcttccattggaatttgatggatggcagcctgtcccaattgaggaacgatgacaagtttgatggtcttgccacgtgtttttttatcgtgagttagggaggcgtataattcatctacattccaaggctggtgtgtagtcggcaagccgaatttttcacacatggcgataatctttgctgtcataccagctggcatcagtccttttttctcagctgcgcgtgagatttgtaccataccgatggcaacagcttcaccgtgcatgacctggccgtagccagcggtcgcttcaatagcatgtccaatcgtgtgaccgaagttgagatagagtctgacaccgttgtctaattcatcttcgacaacaaccttgcgtttgacttcacaggagtggtagataatatagtcagcatgctccagaatgctctcgacagagccgtctaattggtctagggtttcccagagctccacatcatctattaagccatatttgacaacctcgcccattccttcaatcaattctcgtttgccgagtgtttttagggtatcagggtcaatgagaacgccgtctggctggcagaaggtccccaccatatttttggcaaatggggtgttcacgccagtttttcccccgatagaagaatcgacttgggcagttaggctggttggaatttgtaggaaatggataccacgcatataggtagaagcgacaaaacctgccaaatcgccaacgactcccccgccgagagcaatgattccatcacttcgtgtcataccattttttacgagaaattcgtaggcctggttgacagtatcaagattttttgaggcttcaccttctggaaattcaaaaacaatggtttcaaaaccagcttgttctaagcttgactgaactgtttcgcggtagagtgagccaacgtggtcatctgtaataatggcgattttctgaggtttccaaagttctttgacccatgcacctgtctgtgctaaacttcctctttggataaggatgtcgtagggagtgttgggaagattgatggtcagtttcatcagatttcctctctatttgatgtcatatttctggactaattggtcccaaatcaagtcagtcggcatttcctgtccagtccaggattggaaggcttcagctgcttggaaaaggagcatgcccaaaccgttgatagttggattgccttgtgattgggctagttttaataaaggtgtttcgaatggttgataaatcacatccgcaaccaaaagattttcgggaaagcgaatggtagaaggaacaggttgagaatacccatccatgcctacactggttccgttgactagtaagtcggagttggtgatatgttcctgtagtaattggctatcatcaagcgctaggatctgcatgggaactccagttgctcgagcaataggtgtaagactcgcctgtgttctttccaagctttgttgacggcagaaaatggtaatttcctttgcaccatccaatgtagcctgagctatgatagcagtagaagcaccaccaccacctaggatggttagtcgcttgttgcgtacttggaatcctcttagtttttctaaacttttgaagaatccaatgccatcggtattatgaccgattagtaagccatcctgatgaatgacggtattgacagcgccaatcaagcgagcagagtcagtcaggctatcgagataagggatgacagcctgcttatagggcatggacaggttgataccaaacatatcatatcgtttgatattttcaagcgttacagccaaatcttcctcgggaatttcccaagcgacatagacaccatttacacctgtttccttaaaagccagattatgaatgaagggggaaatggagtgtttgattggctttgcaacaacggcagcaagacgagtgtaaccatcaatgttcatagcttacctccaaattatttatcgtataaaaaattaaggaaagaattagacggtttgatgaatttcacgaatcagagcttccgttttttcccagcctaagcaaggatcggtaatggatttgccgaatacctcagggctatcttgacggccgtcttccaagtaggattcaatcatgaaaccacgaacgtacttgcgaatagcttcattccaatcacggttgatgagggtttgacggacgatacggatttgctccaggtaattttttccagaattatcatggttggtatcaattacgataaatggatttttaagaccaaattgttcatactgtttgatggttttcaagagaatatcatagtagtagtttggctcataaccgcccttttcagtattggcaccacgaaggatagcatgagctagaggattgccatctgtatcaacttctgcatcacggtaaataaagttctgtttgttttgtgcggcgtagataccattgaacataacggtcaaattaccggaagttgggtttttcataccagttggcatgtcgacacctgatgcaacaaatctatgttcttggtcttcaaccgaacgtgctccgatagcatggtaggacaccaagtcttccacaagagggtagttggcagagtagagcatttcatcagcagttgtgagtccagtctcagtaatgacacggtaatgcaaattacgaacggctgcaattccgttaatgaggtctggtaatttagaagtatctggctgatgaaccagtcctttatagccttccccattggtacgtggcttagctgtgtaaacccgcatgaccatgaagattttatctttgacttcctcttgaagcttagagagacgacgtgcatattctaggacggcctcttcattatctgatgagcaaggaccgataaccaagagcagacggtcatcttcgcctcggataattcttttcagttcttcatcgcgctgattttttgcagctagaaattctccttctaacttggaaagttcctttactttatcgatgtctaaactggtgctacgtttgtgaattcccatagtatcttcctatctgttgtaaatttctcggatgagttcttgtgttttttcccagcctaagcaagggtctgtgatggattttccatagacatctggattgtcttggcgaccgtcttcaatgtaggattcaatcatgaatccgcgaacgtagttacgaatggattcgttccagtcacggttgattaaggtttgacggacgatacggatttgttccaaataatttttcccagaattgtcatggttggtatcgatgatgatgaatggatttttcaaaccaaattggtcatagagctcaatggtttccaagagattgtcgtagtaatagtttggtaggtatttaccattttcattgactgcgccacgaagaataacgtgagcaagtggattgccagatgtttcaacttcagtattgttgaagaggaaggattgtttcttctgagcagcaaaaagaccgttgaacatgactttgaggttaccagacgttggatttttcaagcctgttggaacatcgatgcctgacgctacaaagcggtgctgctgattttcaaccgaacgagctccgatagcgatgtaggaaaccaagtcatcaaccaaaggcaggttttcagggtagagcatctcgtcagcagtagttaaacctgtttccgtaatgacacgatagtggaggttacgaactgctttgattccgttgatgaggcttggtgcagcatctgtatctggttggtgcatgagtcctttataaccatcaccattggtacgtggcttggcagtatagacgcgcatgaccatgaaaattttatctttgacctcttcttggagtttggccaagcggtgagcataatctaagacagcctcttcattgtcagaagaacatggtccaattactaggagaagacgattatcttcaccttttaagatggcttcaagttcacggtcacgagcttgttttttagcaagtgtttctggagaaagttttgaatgttctcgtacttgattgatgtcaattttttcgctgattggtgtaaacaatagatctccctctttcatttataggttcctcaattataccattatttttaagaatttaaaatcaatatccatgattttatgtagaatttacagtaaattctgaatattttatatataaggaaatttaagaaattttacttacaataggttaacgatttttgcctcatacagtttggataaaaatgtaatggagagaaacggagaagatataaatttatcaaaaaattttgtttatgtccttgaaaaatcttcccaaaaggaacgatagtccttgagtgtgggaagatgcttgaagataatggctatgagataaaaatcttattcatttattgaaaagacaagaaccataatttggataaaggtgaagccgaggataaaggggagagaatcccacgaaataactgcaagcatttcatcaataacgacagttggcctggtaaagatgtcccatgaattcagtcttgcatatcgtccgatatgaatggcaaagctggatagtagggaaagaccactaatcataaacagttttagccagtaggatttgatagaaaaagcagagaaaataagtcgtacactttcaacgccagccatgaccccaaagaaaatacttggaacataaagcataaatagaatcatgctttctcgttgccatagtactgtgttggcaaagtgcatatggacgatgtctgtcaccatgtaaaaagtattggggtagaaaaagagccagaggagacctgctatcactttgaggatatgggactttgtatgattggtaaggattgcaaaatcaagtgctaccaatgccaagaacatattccatgtcaagtcaggtgctgtgacaccgtaccgttttagtccgactgctatgatgaggaaaaagagatgagtaagaatatttttctttgtaaacatagatgacctctttctgtttgagttgtatcatagtatagcatagatagaggaagacttgtagttagaaccattttgtgatttagctgaaaatatgataaaataggatgttgtcaataacagggtttcatttgctctgaatttgaaaggaaaaaaacatgacaaaaacaccgttttacattaccacaccgatttattatccgtctggaaaacttcacatcggttcagcctacacgaccattgcctgcgatgtattggctcgttacaaacgcctgatgggccacgaggttttttatctgacagggcttgatgagcacggccagaagattgaagagaaggcaaaagaagctggtttgactccgcaagcctacgttgacggtatggcggttggtgtcaaggagctctggaacttgctggacatctcttacgacaaatttatccgcacgaccgatgattaccacgaggaagtggtggcggctgtttttgaaaaattgctagcgcaggacgacatttacttgggagagtattctggttggtactccgtatcggacgaggaatttttcaccgagagccaattagaagaggtcttccgagatgaaaacggcaaagtaacaagtggtatcgctccgagcggccacgaagtagcctgggtttcagaagaatcctacttccttcgcctcagcaagtatcaggataagttggtcgagtttttcaatgctcatccagactttatccagccagacggccgcctcaatgaaattatgaaaaacttcatcgagccaggcttggaagatttggcagtgtcacgtacttcatttacatggggcgtgcccgtaccgtccaatccaaagcacgttgtctatgtctggattgatgccctactcaactacgcaactgccttgggttatggtcaggaagaaacagttaattacgacaagttctggaatggaacagtttaccacatggttggcaaggacattcttcgtttccactccatttactggccaatcatgctcatgatgttggatatgaagttgccagaccgcttggttgctcatggctggtttgtcatgaaagatggcaagatgtccaagtctaagggcaatgtggtctatccagaaatgttggttgagcgtttcggcttggatccactccgttattacctcatgcgtagtctgccagtcggctctgatggcacctttacaccagaagattatgttggtcgtatcaactacgaactagccaacgaccttggaaacctgctcaaccgtaccgttgccatgattaacaagtatttcggtggtcaggtacctacttttgttgccaatgtgactgacttcgatgcggacttggcggcagttgtagctgacaacttggcaagctaccacaagtatatggaagctgttgactacccacgcgccttggaagctgtttggaatatcatctcccgtaccaacaagtacatcgatgaaactgcaccttgggtcttggctaaggacgaagcggaccgtgacaagttggcagcagtcatggctcacttaacagcaggtcttcgtgtggtggctcacctcattcagccattcatgatgaccacttcaaatgccattatggaacagcttggtttgggaacagcatttgaccttgaaaatcttgactttgcaggtcttccagcaggtttgacagtggtcgcaaaaggaacgcctatcttcccacgtttggatatggaagaggaaatcgcctatatccaagcccaaatgggtggcagctctgctatttcccaagaggaagaaaaagagtggaacccagctgacgtggaactcaaaaacgaaaaagctgcgatcaagttcgaggactttgacaaggtggaaatccgtgtggccgaagttaaagaagtagccaaagtaaagggttctgacaagttgctcaagttccgtctggacgctggtgatggacaagaccgccaaatcctgtctggtatcgccaagtattatccaaatgagcaagagttggttggcaagaaagttcaaatcgttgccaaccttaagccacgtaagatgatgggcttgctcagtcagggcatgatcctatcagccgaacatggtgacaatttaacactcttaacagtcgatccatctgtgccaaacggcagtcagattgggtaaaaaatttcaaacactcagttaaactgggtgtttttttacgaactaatatagaaaggaggtaatatgttagtagcacttgatgaagatgggcaagtttttaatgtcttggaaaatcctgcgccgcaaggcagtttttcctgtccaggttgtggaggacttgtccgatacaaatcaggaaaagttctgcgttcgcactttgcccatgtaaccctgcgggactgccactatttttccgagaatgagtccgctcagcacctgtccctcaagtcttgtctgtacaggtggttagtcaatgccgaacaagttgaacttgaaaaatgcttgactagtataggacaggtcgctgatttatttgtcaataatagtctagctttggaagttcaatgttccggtctgcccatttctcgtttgcagctgaggacgcaagcctatagtgaggctggttatcaggttctttggttgcttggcaaggatttgtggctcaaggaacgactgaccaatttgcacaagcaatttctctcttttagtatgaatatggggtttcacctctgggaattggatgatgagaagaaggaattgcgtcttcgttaccttattcacgaagacttacgaggtaaggtccactgtctgacaaaggtttttccatttggcgagggaaatttattggacatcttgcgtctgccatttgccaagcaagctttatcgcatcttacttgcccgttagatagggatttgcctcgctacattgctcaacagctttattacaaatcccccaattggttggccctgcaggcagagtcttatagccgaggggagaatttgctgacaaagacggcagaagaatggtacccccacatccgtctgccccgctctgccattggctttgcccaaatacaaaaagatttaaccctagtttatcaggattttgaccagtattacggcaatattgaagacaagcagaaacaggttctatatccacctataatttatagaaaaccaatgtaagtagagatagctgatggaggtgtatatattacttttgaaaatatgctcaatattttatgttagtcatactactgtcggtgaaggttgtagactttgttagcctagtgacgacttgcgatagcgaatggcaaaaactgttttccagttgaaataagtaacctataagccctcactttccgttggaaagaggggattttttatgttagaataaagaatacggaggattaattatgtctaaacaacgttacgaaattgaagaaaaataccagtgggatttaaccactattttcccaaccgatgaagcctgggaagcagaacttgcagatttacaagctgaaactgaaaaaacaaaagaatttgcaggtcatttactggactcagctaaaagtctcttagaaattagcgaaacgcaacttagtcttatgcgtcgcattgaaaaactctatgtctatgcgtctatgaagaacgaccaagatactcgcgaaggaaaatatcaggaatttcaagctaaggccatgggcttgtatgctgtcttttcacaggcttttgccttctatgagcctgaatttatgggcattactgaagagaaattggaagcctttaaagtagaagagccggctcttgttcagtacagccatcaatttgaaaaacttttagcagctaaggaccatgtcttgtcacaagaggtggaagaagtattggcggcgaccagcgaaattttcgaatcaccagctgaaaccttctcagtcttggacaatgccagcctgcgtttcccagaaatcacagatgaagacggtcacttggtgccactttcacacggaaactacatccactttatggagtctaaaaaccgtgatgtccgccaagaagcctatgaagctatgtacggtacttatgagcagttccagcatacatacgctaagacccttcagtctaatgtcaaggtcaataacttgaaagctcgtttgcggaagtacgattcagcccgtcacgcatcacttgcagctaatttcattccagaatctgtttacgatacattagtggcggcagtcaacaagcaccttccgctcttgcatcgttacatcaatttgcgtaagaagctcctggggattgatgacttgaagatgtacgatatgtacacaccattgtcagatttcagcaccaagatttcttatgaagatgctcttaaaaaatgtcaagaaaccttggaaatcttcggcgaggattattcggctattgtgaaggaagccttcgaaaaccgctggattgatgtccatgttaatgaaggaaaacgctcaggagcatactcaggaggtgcctacgacaccaacgccttcatgcttctcaactggcaggataacttggataacatgtacacccttatccatgaaacaggacattctcttcattccatgttgactcgtaagactcaaccctatgtctatggccattattcacttttcttggctgaaattgcttcaactaccaacgaaaaccttctgactgaaaaactcttggcagaagtagaagatgacaaggaacgctttgctattctaaatcattacctagatggtttccgtggtacagtcttccgccagacccaatttgccgagtttgaacaagctatctataaggcagaccaggaaggtcaggtcttgacggctgatttcctcaatgaattgtacggtcagacaaacgagaaatattacggactttctgccgaagaaaatccagaaatccagtttgagtgggctcgtattccacacttctattacaatttctatgtctatcagtatgcgacaggtttcgcagcagcatcagctctagcaaacaagattgtcaatggtagtccagaagacaaagaaaactatctcaactacttgaaggctggtagctcagattattccctcaatgtcattgccaaagcaggtgtagacatgaccaaggaagattacctcaatgatgccttcaaggtatttgaagcccgtttggaagaattagaagctctcgttgagaaaggtgtgcacctctaatatgatttcctataaacgttcgattgtcattcccagtgtgattagccttgttttaatcttgctgggtcttggtggtttgaccaagcaagagccatctatgggaagtgttgtctatttgatatttttacaagctttgctagtttatttatatatattgagaaagcaaaaggcagtttttatattgacaaaacagtacctagaatttcaagaacacttttggagtgaacgtcaacgccattcgttagaagagattgcagagattcgatacatggtttctcctgtctatcgtggctatcagtcgaaacgtttgcgaattgtaggaaataaggggggactacttgcagtcgtcagcttgaataggcttgatggtgcagattttaatgatatttaccattttgtagagcaagtagcaccgcatataagatgggatttttcaaattaataaagagaggggactatgttaacagaagaacaactacaagatatttttgaattagcagatttaatgtcaaatggtgatagggaactatttctccaacttagagaagtagtcttcgccagtgatccacacgagattctcaattttatggaacgtattttagattcagagtcattcgatgatttcttggatcgtgttggagagtctgaaaaggaaaatctttggttaatcttgataaaattactagagcatttgaactatatttgtgtgcgtgattataaggacaatcttgaagattttatctacttttttgattgccttcagcaggtccgcaatgcgggaatttctcttaaattggattcaggtggattaagtccaattgcatctatttcagaatgggcaagagtcattgataacaaatatcttgatgaaaacttttgtctaggggcagtagatatggacacggatagttactatctctttttcagtaagcaggcgacttttattcgacttcaagaactagctggaaatttagggtatcgaattgattacgccaaaaatatgtagagaaaaggtggggaaacctaccttttagtgtattgaggaagaaaatcttgtcggcttatgatataatggattctatggttgaatcatatagtaaaaacgcaaatcacaatatgcgccgtccggttgtcaaggaagaaattgtggattttatgcgaacacgtcaggcgcaaaatacagggtttttgaaagaactggaagagtttgctcatcaagaaaacattccagttatccctcatgaaacggtagcttatttccgcttgctgatgcagacactccaacctaaacgtattttagaagttggaactgctattggcttctctgcgttactgatggctgacaatagcccgcactcgaagattacgacgattgatcgaaatgaagaaatgattggatttgctaaggaaaactttgccaagtatgattatcgccagcagattgaattgctggaaggagaagctatggatattcttcctactttaccagataacacatatgattttattttcatggattctgctaaatcaaaatatattgtatttttaccagaagtcttgaaaaaggtcaaagtaggtggtttaatcattttggatgacatcttccaaggaggagatgttgccaaggacatcaaggatatcagaagagggcagcgaacgatttataagggattgcaacgtttattcgatgcgactttggataatccagatgtgactgctagtcttgtttccatgagtgacggtctccttatgttgaggaaaaatgtagagaatgttgacttaaaacatatagaaatttaagaagtttttaagcttttgtgttataataaaggggttaatgaaaaaaggagagagtctttaatgaaacaaactaaaaaaattctcgcaggtgcagtaacactctttgctgcagtaacactcgctgcttgttccaatgcagctgataaagatatcattacgatgaaaggtaacacgattactgtgtctgagttttatgagaaagtaaaaacaaactcacaagctcaacaagttttgctgtcaatggttatcagtaatgtatttgaaaatcagtatggtgacaaagtctctgcagaagaagtaaataaggaatatgataagaaggcagaacaacttggtgcttcttttaacgcggcactttcttcggcaggattgacagaagaatcctataaggaacaaattcgtaccaataaattggttgagtatgctgtaaaacaagctgctgagaaagaattgacagatgaaaactacaaggcagcttatgacgcctatacacctgaagtaacagcacgtgtcatcaagttggcagacgaagctaaagcaaaagaagttttagctgctgcacaagctgaaggtgcagattttgctcaattggcgaaagacaattccacggatactactacaaaagacaatggaggcgaagttaaattcgattcaacttcaacaactgttccagcagaggtacagaaagcggtatttgccttggatgcaggtcaagtcggagcgtcggtgatttcttcggtagatatgaagacgtatacaacgagttattacgttgtaaaattggatgctaaatcagaaaaatctgctaaatgggaagattataaagataagctgaaagaaattattttggcacaaaagcaaagagattcatcatttgttgctactgtgctgaaagaagcactccaaaaagcaaacgttaaggttaaagacagtgctttccaaaatcttctttcacagtatgtgacaacagaagaaagcagttcttcctcaacgaagagcagctcttcgtcgactgaaagttcttcttctacaacagaatcttctagttcatcaggtcagtaattgacgatttacttattaagaattggtacttgacaccttagttcagaaaattggcggttgttgcgagccatctaagccaagtattttgctacttaatattacaattgaatagtagagcctgtattcacagtttgtggcttatatataaaagttttttgcttgtggatacagtttcttaaatgagaatgacaagtcattgaatgaaggtggtaccgcggtttttcgcccttcgtttgatttcttgttatttttttgggggaggttatcatgaagcaatttcaagtgaaacagcgctttacctttggtggtgaaaaatttgatattcgtgatagttttgggaatcttgcttatcaagtggagggatcttttctcgaaattccaaaacgatttatcgtaaccaattccagaggtggggaagtttgtcagattactaagaagtttttgaccttcctgccccagtttaccattgatatggtagagggacattctttctacttgcaaaaggaatttacttttttcaaggatcgctatactgtggaaaatctaggtttaatcctagacggaaatatctgggatttggattttcgcttgaaaaggccagatggtatgctcgtagctgaaatctccaaagaactctttcatttaacttctcattactccgttactgtattggaggactcctgtgcagatttggtcatttccttagtggtcgcaattgactacatcgaaatgatggaagatgcatcgacttaatcgtgaaataatcattcagtttaactggtccgttaaattgaacccgcctaactatcacttatgaaaggaaagggtatcgagtttattctgaaatgaactcgggctacggactttcccctcaattattactatatgaaaggaaatgtttaatttaactgtttcgttaaattgaacccgctcggaaggctcggaaaaaagataaactgcctaggaaatcaagatttcctgtcagtttcctatttttcagtcgccttctaatcgggcttggtatcttagtttatgaaaaatttatcttctgctcaaattcgtcaaatgtggttggatttctggaaatcaaagggtcactctgttgagccttcagcaaatcttgtccctgtaaacgatcccactcttttgtggatcaactctggtgtggcaaccctcaagaaatactttgatggctctgtcattccagataacccacggattacaaatgcccaaaaatcaatccgtaccaacgacatcgagaacgttggtaagacagcccgccaccacaccatgtttgaaatgcttggtaacttctctattggtgattatttccgtgatgaagcgattgaatggggctttgagctcttgacaagcccagaatggtttgcttttccaaaagacaagctctacatgacttactatcctgatgatatggattcatacaatcgttggattgcccttggtgttgagccaagccacttgattccgcttgaagataacttctgggaaatcggtgcaggtccttctggtccagatacggagattttctttgaccgtggtactgactttgaccctgaaaacattggtatccgtctcttggaagaagatattgaaaatgaccgttacattgagatttggaatatcgtattgtcccagttcaacgcagacccagctgttcctcgctctgagtacaaggaattgccaaacaaaaacatcgatacgggcgcaggtttggagcgtttagcagctattttccaaggggctaagaccaactttgaaacggatctcttcttgccaatcattcgtgaagtagaaaagatttctggtaagacctatgaccaagatggcgacaacatgagcttcaaggttattgcagaccacatccgtgccctttcttttgctattggtgacggtgcccttcctggaaatgaaggtcgtggttatgtccttcgtcgtctccttcgtcgtgcttctatgcatggtcaacgtttgggcattacagagccattcttgtacaaattggtggagacagttggtaatatcatggaaagttactatccagaagtacttgaaaaacgtgccttcattgagaagattgttaagagtgaagaagagtcatttgctcgtactatccatacaggttcacaatttgctgagcaattgatggataaattggcagcagaaggtaagtctgagattgatggtcgtgacattttcaaactctatgatacctatggtttccaagtagaattgacagaagaattggctgagcaccgtggtatgacccttgacattgctggttttgaagcggctatgaaagagcaacaagaccgtgcccgtgcttcagttgtcaaaggtggttcaatggggatgcaaaatgaaaccctggctgctatcacagaagagtcgacctttgtttatggccaaacagctcttgaagcaagcttatctgtcattgtggctgataatgcgcgtacagaagcagtctcagaaggtcaagccctccttgtctttgaccaaacaccattctatgcagaaatgggtggtcaggttgcagaccatggttttgtgaaaaatgctactggagacattgttgcgactgtcatcgatgtgcagaaagcaccaaatggtcagccattacacacagttgagctgtccgcaagcatttcagttggtcaaacctacacacttgaaatcgaaacaaaacgccgtaagggtgttgagaagaaccacacagcaactcacttgctccatgcagctcttcacaatattatcggcgagcatgcaacacaggctggttccttgaacgagcaagacttcctccgctttgactttacgcactttgaggcagttactgcggaagaacttcgtcgtattgaagaagaagtcaatgagcaaatttggaatgccattccagttgtaacggttgaaaccgatattgacacagctaaggaaatgggtgctatggccctcttcggtgaaaaatacggtaaagaagtccgtgtggtgacaattggtgactattctgtcgaactctgtggtggtacccacgttggcaacaccgctgaaatcggtatcttcaagattttgaaagaagaaggtatcggttcaggtactcgccgtatcattgcggtaacaggtcgtgaagccttccttgcctatcgtgaccaagaagatgccctcaaagaagtagcggcaaccatcaagtcaccacaaatcaaggaagtgccaaacaaggttgaaagtcttgcacaacaagttcgtgacctacaaaaagaaaatgcagctctgaaagaaaaagcagcggcagccgctgctggtgatgtcttcaaaaatgtcaaagatgctaacggcattcgctacattgccagccaagtccaagtttcagatgcaggtgccctccgtaccttcgctgacaactggaagcagaaagactactcagatgtcttggtgctggttgcggccatcggcgacaaggtcaatgtccttgtggcaagcaagtcaagcgatgttcatgcaggtaacctcatcaaagtccttgcgccaatcgtagcaggtcgtggtggtggtaagccagatatggccatggcaggtggtagcgatgcctctgcaatccaaaccctcttgaacagcgtagctgataatctataatcgctcaataaactcttttatccattgggtagaagagttttttgaatgttattctagtcattttgacgaacttcataaactttttgacaaaaattattatttttttgacaatgatagttgtcaaaaagaaaagtaagtgttacaatgatattgagataaagatgaaaacgaatccatctggtaaataaacagaaagtaggaactatatatgaaaaagataaacaatagtgacatggcaggttttgtacaacttatcgcgatcatctatctagtttttgtcctactagctgacattatgaagtggcagcagttggatcagactcatgtgactcttgcaatttgtgccatcgcagtgacaactggaagcttgaagaaactaggtggcagaaaagagtcaaaggtaaagtagtaaaattagtcgagtagtaggtggtggaaaattatgaaaaccagtagcaataaaaaaggaattttgattacaggaacaagtgttgtgcgaggtttggaagttataattgctctatttttgatatatgctttcgttcaaattcttggatttggtcagcctatagatatggtgccactcttgatgatggtgagttccctattcattttgaaaaccactctcggcagagaaaaggaaaagaagaatgaacaagacagttaaaaacggagtgaaagtagtcctactatttttcgtactcttcttgataaatattttggtgtttaaagttttatctttgttaggttttgagatgagtttgactgagagaagttatctatttcctccattgctggcgacattggtgacagctctgctattttacaaaatgaaatctaaagagaagagaaatggaagctaaaaagaaattatatgaagttaatatcatggaaaataagaaatttgtgtggggattgaatattcttgctgtggtactcatctttccatttgccttcgtatttggaatgatagtcagttggttgatagctaacggttcgcaatactcggagctatccgtgtcggaggtatggttgcttatcccactctatattctgttaatagttgtgcatgaggctatccacggcatcttcttcaaggttttttgtcctgaaaatcctgtcaaatacgggtttaaatggaaatcgggcatggcctatgctaccagtccaggttccctctacaatcggatgcaaatgctggtgatttccctagcaccctttgttgtgattagtttggtcttgactatggtagcaggttttgggatgatgaatattactctttacttcatgctggcaaccatgcacgctgcctcttgtgcaggtgatttctactatacctatctcttattggtcaagtttgccaagggaaatatagctgtcgaagacacagaaacaggcttgattatctaccaagcctagaaaggaaaatttatggaatatgtcttaaaaaatcggctcaaggaattgcgagccagagatggtctcaatcagacagagctagcaaagttggcagaagtatcacggcagactattagcttgattgaacgaggagaatacacaccctcggtggtcattgctatgcggattgcacaaatttttaatgaaaatgtggagaatgtctttcaattagtggaggtagaagaatgaaacaggggaaacaaatttcgacgaaacaaagatggatgagatattcagcgtatatgctgatttcagcaattttgggtggctttatcggtttctttggaatattaatctttaaattcagcctaccttcttatctcaatttagataattttctaatttgtttgaggattattacatttttaattttcgctggaaccgtatattttggtgttaaagctaatcaaaattataaactttatcattccatttcagatgaggatgaggaacatgttgatgaactatataagaaaatgtatcgtaacctagagtacgcgaccatttcattcaatgttgctgtatcattgacattgttaaatttggttctaggatttggtgttaccttcttcgaagacggggcgatcatgtacgggtcaatttttgatgtagttttctatgtcattcttctcatttctcagatttttatcatgaaattaactcagaaaattcgtgactataagttatccgcttttgctacggtaaaagaaatgaaggattttgctgaggcgatggacgaaggtgagaaacaagcaaactacgaaatgagtttccaaatcgtcttcactttgaatcaaatcgtgttaccaggtttgtatctattcctatttgtacttagcatgctattgcaggaacgacaaattacggcatttctagttgtggcgtttttgcacatttatatcaatgtgatgcaggttcgcatgatccgtcggtattttaaataaggaaaggttttggtagtgattatgaaagagaataaaaagtttatatcggttctaaaaattgtttacttcgtggggttaatcggtctcggtctgtacgcagttggctatattttcggagaatggctggctactgggcagattgatttgtctaatctgaatatcctcttgccgatggttttgggcttgccagctctgctattgttcaaaaaagaaagtgataagaattgatttagtgtatgtgaaggagattgctatgaatagacttggaaatgtcaaagattggaatgtggttaaaaattggaagtttctcttagtgggactggcagtcgttgcactgaatgtattgacccagttggccatgtttgccctaccaaattttgacggtaataatctactgattgctgcagttcttttattgttagccgtggtgcttggtcttatcttgactggtaaattaggtctatggaaaggtgagcagaaatgggggatggttgcgaatgttgggtttgtagtcctcgcttttatcgttatgtttggtctgaaaataattggtgggcaattgattatgttggaagagggatatggtcaaacgactgccaatcaggaaatcatcaacaattcaggcttaccaaccttagttttgtttctctttgcagttttctttgctccagttttggaggaactgcttttcagagggattcttatggggagagtatttggtaaggattcgattgtgggattattgctatcaagttttttgtttggacttattcacaatccgaccaatatcggatcttgggttgtctacggaggtatgggcctggtcctgggactcgcctatcgtatttctggcaaatataccaatgcacttattctacacagtctgaataatcttcttggatttttgttgatgctactgatgcagagtctgggcttgatataggaggatacgatgaaactatttttatggattctagtaggatttctatttttcaattctctatcagataggaaaaaagtgaagcagttgcaagctagggtaaaaaagttgcagaaaactacaaaaggagaaaatcagatgtccgttttattgaaagaattgatcggaagtaaagccaaaatccgctttgatgaggaattttctattgcttatgaatacactattttggcagttgatgaggaatgggttaaaatttctcgtgaattagcgaatggggagattgaaaccaagttggtacgggtcgataatattattgacttgagcttttagggagggattatgttaaaatttatcaaacacgtcgcattactatttctatactttgttgcctatcaaattgcttcaggttttctgatggtaggaccaactttacaaagcataccagacatacctgcccagttgattgacagtacaatttggatttgtgcgataattggtcttgttctctccattgcgctcattattctgttatggaagtatatctatccacgtcattctgttgactatcgtgtgacagcttcatggttccataagattcaatggccgatattgctctatattgcattttttatcatccaatttatagtaccagtcccagaaagtgaaaatcaaaagcttgtgatcgaattcgtatcagcttatcccttgattgcatttagctcagtagtgatctttgctccaattttagaagaattgattttccgtggattttttgcgacctatttcttccctaaaatggcagatatgaaggctgttggaatctatctatttgtaacgggggctttatttagtctggtccatatgccagcaactcttccccaatttttgatttatttcacgatgggactcaatcttggttggctctatttaattagacgagatattcgttatccgattgcgctacatatgttaaataatggaatttcctatttgatgattctatttttggtatagacaatatgtaaagacccccagttgagaattcgtggatttacctgtacactagaataaaaaacaatcaacttctaacaggaattaccacactcaattggaggtcttatatgtttcattttaccacacttttcatcggaatggatgttcacaaagaaagtttttcactctgctattatgatatgatggcgaatcaattcaaacatagcactaaagttggtccaaatgttagctatattgtgaactatgtgaatgagcttcgtcgtttatatggtcaagatgtagaagtgttatgtggctacgaagccggatgtcttggatttaccctatatcaccagctacaagctcacgggattccctgtatcgtgatggcgcctacaacggtgatgaaggaaggatctaagcgtgttaagactgataaaaaagatgcagctcagctcacaaaagctctggcctttcatagctatcggcctgttcatatttctactgttgaggatgaacaagtcaaagaatatatctgcatgagaacagaccacaaagtggctctgaagaaaatcaaacaacaaattcttgccttctgtctccgacatgattttcgctataccgagggaagcagtaattggacacagaaacatgtccgctggctctgtcccctaaatattgatggactttacgcagagattttgacagaatatctattgacctatgagaaattagtagatcaaatagaacggtatgatgcgcgaattgagcaactgggtcaaagcgacagttatcaagagaaggtctctcagcttttttgctttattggcattaaaacactaaccgctctttccattgtgacggaaatcggtggttttaaccgctttgcgacagctcaacattttgcttcttatcttgggctaactcctagcgaaaattctagcggcgacagggagagaagaggtgctatcaccaaaactgggaatagccatgtgagacgacttctgatagaagctgcacaatcattggctaaggggacgattgggtataaatccaaagaattgaaaaggagacaaagtggaaaccgagtggaggtgattgcttatgcggataaggctaatgaacgcttaagaagacgttatcgcacacttgttctaggaaaaaataagaaacaaaatgttgctaaaacagctattgcacgggaattatctggttttatttgggggatgatgacaggaagaatagcttgaagttagcacttgttttcatgtacacttttgacaattaagttttatcatcgcagagcgatgaggaatccctatttctatcccaaatcactgggtgaatttggacagaaataaggattgaaataatgtttgaatggagagtatcttgaaggagtttaggacttcaaggtttgagtcatctacgaaacaactaagtgacacaattgtgatccacgcttatagagagtaggactcgcggcagaaccattgacctgtgggtaaccaatccacgaatattagagtggccaatgcccgaagctaaaaactaggctctttctagatacttttcattttttatcagttcgattgtttttacttgacaaagggctttacatatcagtcttttagtttgcttttagtactcgcttcaaaggttcggggaacctttgaaggctggagatagggcgaagcaagttctcctcaatagctacaggttgctagaacagcctaaaagctgttctaggttggaaataaggaaacgacgtttcctcgctcgtcgaagtaatcaaagataaactgatatgactatataaaatgaattacagaatatatgattgagatagatggtaccttgttgcacgttgcaatagggtattttttatttagagtagtaaacacagggtaaaaatgttaatgtttgagttcctattaacatctcggcggagtagttgagttttcgaatattctggagattgtttgaggtgggaaattggtagtgagggagtcagtcgtatcacttcccgctcccattttgtatggtttactttcgtgaatgtagtatagccaattttggataatatatgaataatgatatgtaaaatgtttactaatgattgataaaatcgaagaagaaaatcatacttgtgttaagtatattttattgcttggggaatgaagatactcgaattttataagattatatcaagattcgttttgaaagtatttaaaataaatgataaaaaccgttgacaaaaccggtttactatattacaatacaatttgtaaacgctttacaaattaaaatacaagggagttacgaatatgaatcagcaattttcattggatcaattttctctaaagggaaaaattgctttggtaacaggggcgtcgtatgggattggctttgcgattgcatcggcctatgcaaaagcaggggcgacaattgtttttaatgatattaatcaagagttggttgatagaggaatggcagcctataaggcagctggtattaatgcgcatggctatgtttgcgatgtgactgatgaagatggaatacaggctatggttgctcaaattgaatcagaagttggaattattgatattctagtgaataatgctggtattattcgtagggttccaatgattgaaatgacagcggctcaatttcgccaagttattgatattgacctaaatgctccgtttattgtttctaaagcggttattccatctatgattaaaaaggggcatgggaagattatcaatatttgttccatgatgagtgagttaggacgagaaacagtgtctgcttatgcagcggctaagggtgggcttaagatgttgacgaagaatattgcttcggaatacggtgaagcaaatatacaatgtaacggcattggtcctgggtatattgcaactccacaaacagctccgttacgtgaactccagaaggatggttctcgtcatccatttgatcaatttattatcgcgaagacccctgcagctcgttggggtgaagctgaggatttgatgggtccagcagtctttttagcaagtgatgctagtaattttgtgaatgggcacattctttatgttgatggaggaattctcgcttacattggtaaacagccggaagcgtaataaacgaattaacaaatttaacaaattttgatataagaagggaaaaaacgatgaaaattgcacttattaatgaaaatagtcaggctgctaaaaatagtcttatttttgaaacattgaagtcagtaacagatgctaaagggtatcatgtttttaactatggaatgtatggtaaagagggagaaagtcagttgacttatgtacaaaatggtctgttggcttcaatccttctagttagtaaggcagcggattttgttattacaggttgtggcacgggggtaggtgccatgttggcggctaatagttttccaggggtagtttgtggcttcgcggtagatccgacggatgcatacctcttttcacagataaatggaggaaatgctttgtctctgccatttgcaaagggattcggttggggagctgaattaaatctcaaattactttttgagcgactgtttgcagaggaaatggggggcggatatccccgtgaacgcgttattccagaacaacgaaatgctcgtattttgaatgaaatgaaagcagtcacctataaagacttactgacagtacttcaggaaattgatcaagattttttgaaagaaactatttcaggtgaacatttccaagaatatttctttgccaactgtcaggacgagtcaattgcaacatatttaaaaacagtattagaaagttaaagagtggggggcggttatgaagaaggtattactgattggtgaacctttaattcgcattacaccaacaaattatcaagaattgacagatggtgtagaaagtcgtgtgttttttggaggttcagaaatcaatgtcgcttgtaatcttcaaggatttggatgtgaaaccaagcttttgaccgcactaccacaaggctctctaggtgatagatttttagatttcttagatgggaaagggattgatacttccagtgttcaacgtaagggggaacgtgtgggggtatactacatggaagcaggatttggttgccgttctagtcaagtctactatgatcgtggccagtctagtttggaagctattcaagtcgatcattttgatatggaacaattatttttagaggttgggttggttcactttagtggtatcaccgtggctattggttcagctgttagggcatggcttgttcaagtattaaaagaagcaaagcgtcgtaaaattccgatttcgatggatcttaattggcgttctaagatgattggattaagagatgcaaaaaaagtgttctcgcaatttgcgacctatgcagactattgttttggtctggaacctattatggctaatgaaaaagattgggaattatttgaaagagatacggctactgtccatacaataagagaacggatgcaaactttaaaggaagcctataagttccaagcaattttccatacgattaggcagacagatgaactaggcagaaatttgtataaggcttacggattggctgatgaattttgttgctctcaagaattgaaaactcaggtgttacaacgtgttggcagtggtgatgcgtttgttgctggggcattatataaattgttagaggggacgtcgttaaaggctattttagattttgcagttgctagtggaacttataaatgtagcatagaaggggatcacatgcggcaatctcttagaaaagttgagtctttattagaggggaaaaatgacattatacgataaaggagaaaaaatgagtccatcacaaattatttcaaaattgaaggagcaagggcttgttgtagtcgttagaggagatgacaaagaagtcggatttaagacggcacaggcctgtattgcaggaggaattacagctatagaggttgcttatacaaatcctgacgcgaatatgattattacagaacttagtcgatgccataaagatgatgtttctgttttaattggggctggaacggttctagattcagtaacggcacggcaagccattatggcaggagcaagttatattgtttcaccatcttttaatatagaagttgcaaaaatctgtcatctttatgcagtgccatatcttccgggctgtatgactttaacggagattacaaatgctttggaagcaggctgtgaaatggttaaactgtttcctggtagtgttttgggggcaaactacattactgcaatcaaaggaccattaccgcatgtttcaatcatggtaaccggtggagtaaagcttaataatgtttcagaatggtttaacgctggtgcaactgttcttggtatcggtggggaatttaatcaattagctactaaaggagagttcggtacaattcaagaattagcgtcctcttatacaagtgttagagataagatgaagtagtttatttcaaaataaggactgtatttttaacgttttcactttctcctgcctccaacggggttgaatgtgggagaaagtgagatgttacaggggaaattttgaacggaaacatggagatatttggtactcctgtttatgaaaagagggagctggagaatattttttaaataaaagtccaacgaaatataaaacgcttacatttttttataaaatctattgacaagtggttgtcaatagtctacaatacaaagtgtaggtaaaccggtaaagttaaaaggagagaattatgattaaagtgattgtcgttgctcatggacagtttgctagtgggattcttacttcactaaagttaattgcaggagaggtggagaatattgaggcaattgattttagtgaaggaatgtcggcgcaagaactaaaagcacgcatcaaatcagctatattaggcgaaagagaagttttgattttaactgatttactaggaggtacgccttttaaagttagtgtagaattagcaacagaacagaaagagcagaatgttgtcgttctttcaggtttaaatcttgcgatgattttggaagcgaatttttcacggttaacagatgatttagaacaattggttggtaaattgattaccacctctaaagatggaatcgttgattcggtcagtctgttagcagaggataaccatgatgaagagttatttgaagatggtatatgagggagaaatgcatgattaaggatgttttgattgagtcaattgctaaaaaaagagagtttagaaattccactctattgagtaagaaagaagttgtggctgcaatagaattggcgattcaacaacttgttatcaattgtgaatattttggtgaatcgttcccgactccggccacatttgataaccattatccaaagatggataatacagagtggacaaatggtttttggacgggcgcgctttggttaggacatgagtattctttgaacaatgaaatgaaagcgttagcaaaaaagaatacgacatctttcttggaacgtgtcaaacaaagaattgaattagatcatcatgatttgggatttctgtattcaccatcaacggtagctgattataaattgacaggtagtaaagaggctttagaggcttcgctcttggctgctgataaattaatggagcgctatcaagaaaagggaggttttattcaggcctgggggcaacttggtaaagcagaagattatcggttgattattgattgtttgctgaatttacaattacttttctttgcttatgaggagacaggtgagcagaaatattatgatgtagctcttagtcatttctacgcttctgttaatacagttattcgagatgatgcttcaacatttcatacctattactttgaccctgaaacaggaaaaccgctcaaaggggttacccgacaaggatttagtgatgactcttcctgggcgcgtggtcaatcttggggtatttacggtattccgttagcttaccgtaaaattaaagatcccgcatgtttaaatttgtttaaaggagtaaccaactactttcttaatcgtttgccagaggataacgtttcctattgggatttaatttttaatgatggtagtgggcacgctcgtgattcttctgcgacagcaatagcggtttgtggtattcacgagatgcttaaatatttgccagaagttgatgaggacaaggaaacttataaatatgctatgcacacgatgctacggtccttgattgataactatgctaatcgtgagttagctccaggtcgtccattgcttttacatggggtctactcttggcattcaggaaaaggtgtcaatgaaggaaatacttggggcgattattattacttagaagctttgcttcgtttttataaagattgggaattatattggtaggaggttaaaatggcaacaccaaatattgtaatggctcgtattgatgagcgactaattcatggacagggacaactatgggttaaatccttaggttgtaatactgtcatcgtggcaaatgataaggttagtgaagataagattcagcagacattaatgaaaacggttattccagattcagtagctatgcgtttcttctctttgcagaaagtgattgatgtgattcataaggctaatcctgctcaaactattttcttagttattaaagatttgcaagatgcactagctttggttaaagggggagtaccaatcacagaattaaatattggaaatattcataatgcgcctggaaaaatgcaagtaacacggtctatcttttttggttcagaagataaggctatagtgagagagttgaacgatgtttataagattcgcttcaacacaaagacaacgccttctggtaatgatggggcagttgaagttaatatattggattatatttaaaaaataaggagaattatcatgacgatcagtctaattcaagcagctcttattggtctgtggacagctttctgttttagcggtctattattggggctttacacaaaccgatgtatcgtgctttcttttggggtcggaatcattttaggagatctaccaacggctttagctatgggtgctatcagtgagctggcatacatgggatttggtgttggtgctggggggaccgttcctccaaatccaatcggacctggtatttttggtactttgatggctattacaagtgctggaaaagtaacaccagaagcagctttagcactttcaacacctattgcggtaggtattcaattcttacaaacttcagcatatactttacatgcgggtgctccagaatcagctatcaaacatcttcgtgcaggaaacctttctaaatttaaacgtgttgcaaatggtacagtgattactttcgcctttttaggatttgctcttggtttcttgggtgcctattcaatggatactcttttgaaattggttgaaatgattccaccagtattattaaccggattgagtgtagcaggtaagatgcttccagctatcggttttgcaatgattttgtctgtaatggctaagaaagaattgatcccgtttgtattgcttggctatgtttgtgcagcttatctacaactgcctgtaattggtatcgcaattgtcggtagtatctttgcacttaaagaattctttaataaaccagaacaagtggcagtgaaacaggaggaagcacacgatgactggatctaaactaactaaaaaagattatctcaacacttctttacgggccttcttcttgcagaatggtttcaattacagtaattatcaagggattggctatgcaaatgtcatgtatccagcttttaagaagcattttggtgacgacaaagaaggattaactaaagctttagaagaaaactgtgagttttacaataccaatccacattttcttccattcattactagtcttcatttggtcatgttagaaaatgatctcccagaagaagagactcgtgggattaagatggctctgatggggccgttggcaggaattggtgactcactttcacaatttgtattagccccacttttatctacgattgctgcctctctagcaggtcaaggactggttatgggaccgattcttttcttccttggaatgaacattatcttgacctctatcaagttgttgactggtttgtatggctataaatttggtaccagcgtgattgataagttgagtgaccaaatggcaacaatttctaaggtagccaatatcatcggtgtgacagttatctctggtttagcagtaacctttgtaaaaatttcggtgccaattacctttgcggcgggtgaattgacagaaggagcagatcagaaaattgtgaccatccagggaatgctcgataagattgcccctgcattgcttccagccttgtttacgattttggtttactatctcatcaagaacaagaaatggacaacctacaaactagttatcctgacagttatcatcggtattttgggtagctggctgggcatccttgcataagcgcctatggaacaacaaactctctactatgtactaattattttagtagctctatcgaccatacttcctgtactcacttcttatgtcaatcgtaagcgacaacaaaaagcacttgaggagcaactggaaaaacgccaacgctacttatcaaccttacaggctggagatgaggttatcctcttctctgggctgcatgggaaaatcatcaaactaacagacagcttggtagaattgcagattgcagaaggtgttcttgtttacgttgaaaaagagtcgattatgggaaaagccaaagaactactttttacgaagtagttcttctttcttgcctccgcaaggaagcggttgcaggattaaaattatacccctgggacattgttttgccccgcataaaaaggaaaggaaacaccaatgggattttttatcagtcaaagcaagcagcattacggcatccggaaatataaggtgggtgtctgctccgcccttatcgcgctgtctatcttgggaacaagggttgcagccaatcaactgccaagtacagaaacagctagtccacaaagcagtcagttagtggaaacaactccagaaacgacagaagcagttaatcttacgacagaagcagtaatgacaagcgaggtcagctctgaggttagtcctgttacatcaacagaaacccagccttcaagcaccgctgcagaaactcttgctagtccgcaagctgttcaggcgacaaaagaagaagagaagaacctagtagccaacggggagttcgccagtacaacagcagcatcaggaaattgggcagatccggcagctacaaactgggaaacatggattcctgcaaatgtgaagaaagaaaacggacaggttcgcattgatgagggacggctgcatatctcttcaacagctagctatcgagtggcagtgcaccaaacagtggatgtagatcctaacaagcgctatctctttagctataatgtagaaaccaaggacctgaaagggagcggtgttcgtgttcgcttgcatagtttgactgcagaaggtaaggacttgagtccacaagaatttgcctatacaccttataaaaatggaagtcaagcggagcacatagagcagatcttgacggtatctccggaaactcgtaaattgaaggtggaactgttttttgagaatagtgtcggccaagcctggctggataacatctcgctggtcgaatacgtagaaaagacaccagaaacaccagagccaagcctagaacttgtccaacctgaaacagggcaaataagtcttgccagcaacaaggtctacctgcctgttcggccagacctgacctatcggattgcggatgcggctgtggccatagtagagaaaaatatgattcgtccgcttgcggctggaaagactcaggtagatgtttatgataaagacaccaaactatctagtttcgagctgacagttacggagcatcaagcaacagtctttgataccttaaggaacaactgggaagatatttctttagccaataaacgctaccaatctaacgatactcagatgaaagcctttctagggcgtttagatgccggcgtagcttcttctcttaaaaaatgggttgaaccaacaaatcagggcaaaacgattttcaacgatattgactttagtaaatccagccatctgacaacggtctatcgccgcttggagcagatggctcaagtagttgagaatccagactcagcctattaccacgaccgctcacttatcgatttggtcagaaaaggaatgaactggctttacaccaatgtttataatgaaaataagtcaattgatgggaattggtgggattatgaaattggaactccgcgtgcggttgtcaacaccttgatctacatgcatccctactttagtcaggaggagattctaacctataccaaaccgatttcaaaatttgtaccagatccaaccactatatccgtaaaacattgaccaatccagtcccagcagttggcggtaatcagacggatttgagcaaggtggccatcttggaaggtgctcttcgcgaagatgctgaccgtgtgagggctggtgcacaaggtttgacaacgataatgaaatttgtagataagggagagggcttctacaaggatggctcctttatcgaccacaccaatgttgcctacacaggggcgtatggaaatgtccttattgaaggtttttcacagttactaccggttattcagccaacggagtttgccctcaaggaagaacagaccaacattctttatgaatggattgaaaaagcctttatgccaatattggttcgcggtgaactgatggatatgacccgcggtcgttccatcagtcgggcaactggtgaatcacatgttcaggctatggagattttaaggtctttggtccgcattgcagaatcggctcagcctgagcaaaaaaacaaacttctctcctttgttaaggcacagctgacctctgataccttctatgacagctaccgcagcctcaaatcctataaggatattgatttggtcaacaagcttttagctgataatcaaatccctgctgaagtagataaagattatattgcagccttcaacaatatggataagtttgtttatcgaagcgctcaagaaggctttacctttgccttgtctatgtactcttctaaaactcaaaactatgaagatatgaacaatgaaaaccgcaagggttggtatacagcagatggcatggtttacctctacaatgatgatttgagtcattacagtaaccactactgggcaacagttgacccgtatcgcttaccgggaacgacaacgaccaaggacaaacgagaagatggcagtggcgaggtaactcttgcaagtgactttgttggagcaagccagttaggcaaccgcttagcgacgattgcaatgaatttcaacaactggaacaatagtctgactgctcgtaaggcttggattgttctgggaaataagattgttttcctaggtactgatatacagcatcaatctgctcaaggcgccgtgacaacgattgaaaatcgtaaactcttgaccggagaaaaatatagctattacataaatggccagccagttgatttgtccaaagaagtagtgacagataagactcaatccttttacatgaccaatggcaaggacaaccagtccatcggttacgtcttcttgaaccaactgccgacctatgccaaattagaccagtgaactggcaaatggagtgacatcaactacaaccagtcgaaagaagaagtgagcaattcctttgttagcctatggcatgaacatgcacagacttcaagtaactatgcttacgtccttgttccaaaccaatctatggaaaaagtgaatcaggtggctgctagtgtgaaattgcttcatcaagacagggatttgcaagtggtatacgaccaagaacagaatgtctggggcgttgtgaaatacacggatacagcctacaagctgacagatgatattaccttaacagattccggtttgtataccattcagaaagtcgaaggtggctatcgcatcgccttttacaatccgtctacccgaaccgtaaagaatggcattgagttgacaaaggcaggttctagtctgactgttgagatggagccaactgcggcttatccatccactgtctggaaggttactatgccagaaggttctgataaacaaactggaagtgtcgaaaaaacagaaaaagaagaaaaacaactcaaggaaaaccaaccaagtccagaggtgaaacaagtggttcatcatgctgccgaaaaaacaaagtcgagtaagccccgtctgccccagacaggagaagaagcaagtttaggtcttggtttcttaggtttgctaaccttgggggcagtggtggatttcaagtgtcgcagatcgcactcctaaatgaaattcgtgggtgaagggggagcgggaaagaactcgactagtcaaaaaagagttcgtcaacaagtctttatttctagttgttgagctgaaacagtctatccccagactgtttcactcccacccccgcatagttgattagatcagattcggagtatgaaatacgaattgctgaaatttgttttggaactcctatctccaacctttagcagtccactgaactgttaaagccaatcaatcactgcgctgagatattgatatgaactttgaggagtggatctgggctttgcccagcctctcttcttttggagaagcgatagagaaaggacttgttatgcaaacaatattcggcaaaatagtagccaatcagtcagcagagtcggtcaaaacctatattctcaatcaacaagatgcagcttataaagagcttctcctttcttgtcaaaatttattaaatgatatttttatctttgaagacaattgggatatggaaccttgttcagtcgggtatcatcttgctcctcttgactggacagccgactgccatggggatgaggaatggacctttatgctcaatcggcaggaatacttgtggaaattagttttggcctatctggttgaaaaagattcgcgctacatggagcaggttaaacggtttatctttagttggatagaacaagtgacagattggtatcctaaaagaacgagcagtcgcaccttagatacggctatccgctgtctaagctggctcaatattctcccatttttaattgattggggcggactaagtgaagctgagcgtagccaactgttagtatccattcaaaaacaattatcttaccttcacagtcattaccgtgccaaagatacgttgagtaattggggaattttccagactggcgcaatgctcttggcccatgcttatatcggcgatcaggtggatttagtagagcttcaccattttgctcgtcaggaaatcgaagagcaaattcaaactcagatattggaagatggaactcagtttgagcagtcttttctctaccatgtggaagtttataaactcttgctaggactagctttcagcttgccagattatcgaaaacagtggacatctattttgaaaaaaatggcagactatgtcttacagatgacggggccagatggcaaaagtgtggctcttggcgatagcgatgttcattgtacttctgacatcttacagatgactgcgattttctttgaagatggcacctacctagtagataattccaagctagatttaggcgttctcttcttggtcggagaaaatggcttgcgcatatttgaacacttgaccgctcaatccagctcgtcagggggacagcatttttctgaatccggtcacagtattgtcaaagaagtggacagctatttatgtttcaaggccggtcccatgggaagtgcccacagccactctgaccaaaatagcttgtgcttttaccacaaaggacaaccaatcgtaattgacagcggtcgtttcagctaccgtgaatgcgaggagcgctacttgcttaaaagcgcttgggctcacagcacttgtatccttgatgacaatgctccagggcagataaagggttcatgggaatatgacacgtatcctcagtttattagtcacagttataagggttttgaacactgtcattggatgcagggcatttatcaggctcagaccagccaaggcttgccttactggcataaacgacagctccttatggttggaggcgatttattgctgatagtggatagcgttgattgctcaggccagcatgagttgatcagtcaattgattttagatgaaagagtcaagattggagaagagcggttaaatgatcttcggctatatagtcaaaaggattttgaaatccagaaaaccgtgcgttctcctcgatacaaccaactagtagagaccaataaactggtcaaaaaagagagttttcaagatagattagttacatttactctattagcagatgaagcaattcgtgtcaagcaattgccagtttaccaaacagactatcatttgatagaaagcggtttggcttttagctgtcaaggaaagggactgaatattctgttagtggtttctgataatgatatatgtaagggagagaaattgcttcaagtggctggttataagttgagaggtaagtgcttagtagtggatagggataagagacaagttgtccgactcaaaaattagaagggacagaaaaaaatacagtcatttctgtgcaaaataactgataaagtacggatagtatgatagaataaagtaactaaaggaggtatcggtaaggtgtcagagaagtttaccatcaaagatattgcagaactggctcagacttcaaaaacaacagtttccttttacttaaatggtaaatatgaaaagatgtccaaagagacacgcgaaagaattgagagagtcattcgcgaaacagactataaacccagcgttgttgcgcggagcctaaattcaaaaaatactaagttgattggagtattgattggtgatattacaaatacattttccaatcaaattgtcaaaggtatagaagaagaagcgcataagagtggctatcaagttatcatcggaaacagcaattacaatcaagaaagcgaagataagtatattgagagtatgctgatgttgggtgtagatggttttattattcagccgacatcgcattttagaaaatattcgcgcattattgaggataagaaaaagcatatggttttctttgatagtcagctttacgaacaccgtaccagttggattaagacaaataattatgatgctgtctatgatgcaactcaactatgtgtagaaaatggttatcaaaaatttattcttattacagctgacattagtcgcttaagtacacggattgaacgagctacagggtttatggatgctctgttagattgtaaacaaagttatcaagatttaacaattgcagatgaaaatacggacatagaggaaattaaatgttttcttcaaggggtggtaaatcctcaggaaaagaccctagtattcgttccgaattgctgggcgttacctttagtttttaatgctatgaaagaacttaaatatgactttcctcaggttggtcttttggggtttgacaatactgaatggacaaatttttcatcccctactatctctaccattgttcaacccgcctttgaagaagggtgtcaggcaacaaggatgctgatcaatcagattgagggcggaaaccaagtgggacgacaacaggttttagattgcacagttcattggaaagattctacattctaagttaagtcaaattttacttcttaggaagaggagcagaacgaagtagaatattctgattgagagctcactgaaaccctccttgaatcgcctaatatatacaaaaaataggaattttcccttaactggtgggagaattcctatttttatgccaatctcatcgagatgatatattaacattatatacgattttaaactcaacagatttctatagtcttttagtactaggcaatgagccgcagacagtactggagtgccgcacagttgattaggttggatttagagtgtaaaacacgaacaaatccgccaatcaaccactgcgctgagatgttgacacgaactctaagaagtggcgctgggctttttgcccagcctcacgtcaaagataaacaaaatgactataaaacggaaaaatagaaatgatatttttcctaagatctacaacccatataaataatcatcatctgtcatagcttccacttcaccaagaagatagccgttaccgacttgggagaagaagtcgtggttagatgtaccggttgagataccgttcatgatgattgggttgacatcatctgctgaatctgggaagagtggatcttgtcccaagttcatgagggctttgttggcgttgtaacgaaggaaagtcaagacttcctcagtccagccaactgcatcatagagggagcgtgtatagccctcttcattttcgtaaagttggtagagcaggtcgtacatccagtcgcgaagtttgtcctgttcttcctctgataattcattgaaaccaagctggaacttgtagccaatgtaggtaccgtgcacagattcgtcacggataatcagtttgatgatttctgcaacgttggccagtttgttattcccaaggtagtagagtggcgtgaagaaaccagagtagaagaggaaggtttcaaggaatacgctggctactttcttttcaagtggtgtacctgtttcgtagatttcattgataatctttgccttgcgttgcaaatattcgttgctgttggtccattcaaagatgtcttcaatctcagacttggtattcaaggttgagaagatagaagagtaagatttggcgtgaacagactccatgaattgaatattgttgtaaacagcttcttcatggggtgtgcgaatgtcattgcggagggcttggacacctgtttcagattgaagggtatccaagagggtcaatccgccaaagaccttaccaaccaggtctttttcttcagcagtaagtttacgccagtcatccaagtcgtttgataaaggaatacgtgtatcgagccagaattgctcagtcaacttttcccaagttgacttgtcaataacatcctcaatggcgttccagtttatggctttgtagtaggtttccatattactttctttcgttttatcaataattattttttgcgttttccgactaagtattttcctgcttcaggactaccgtggcgtaatccatccgcagctagtcggtcgctcgtttttttgagcttattattttcttttttagtttgtgaataagctttttttagtacgttattttctctttttaattttttattttcttgttttgttttaccaaatccaaacataaaaaacctccagaaatattgaatagctttattttagtctgtaaatcagattacacaactttcacattggtttgcgccgacttcttcgccgtcatcggtaaaggtacggatgtagtagatagacttgatacctttgttgaaggcgtagttacgaaggatagagaggtcacgtgtagtttgtttgttctcttttttccattcatagagttcttttgggagctcgctgcggaggaagagggtgagggacaaaccttggtcaacgtgttctgttgcggcagcatagacatcaatgaccttgcgcatatccatatcgtaggcagatttatagaatggaatggtttctgttgtcaagccagctgctggatagtagattttaccgattttcttctcttggcgttcttcaatccgttgtgtgattgggtgaattgaagcagaaacgtcgttgatataagagatagaaccgttaggtgcaacagctagacggttttgatgatagagaccatctgccattaccttttcacgaagctccgcccaatcttgtccacttggaatgaaaattccttcaaatagttctttgacacggtcagattgtggttggtagtctccggtcacgtatttatcgaaataagtgccgtctgcgtattttgatttgtcaaaattatggaaggttgccttgcgttcacgggcaatgttatttgattctaccaaagtccagtagttgaggagcatgaagtagatgttggtaaattctacagcagtttttgaaccgtaatcaatcaagttctgagccaagtaagaatgaagtcccatagctccaagaccgattgaatgcgcttgactgtttcctgcttcaatagatggtacagctgaaatgtgtgaatgatctgtgacataagtcaaagcacgagtcatggtacggacagaacgtccaaaatcaggcgacttcatcaagttaacgatattggttgaaccgaggttacatgaaacatcagtacccatgctcaagtattcttgcgaatcattaagaatgcttggtgtttgaacttgaaggatttccgaacagaggtttgacatgataatcttgccgtcaacagggttgctacggttagctgtatcgatgttgataacgtatggatagccagactcttgttggagtttggaaatttctgtttccaagtcacgtgccttgatttttgtcttacggatacgtgggtttgctaccaactcgtcgtatttttctgtgatgtcaaggtagctataagggacaccgtattccaactcaactgagtatgggctgaagaggtacatatcttcgtttttacgtgccaattcgtagaatttatcaggaacagtaataccgagtgataaggtcttcacgcgaactttctcatcggcattttctttcttagtcgaaaggaaggaaataatatctgggtggaaaacatcaagataaacgacaccagccccttggcgttgcccaagctggttagaataggagaagctgtcttcgaagagtttcataacaggaacaaccccagaagctgccccctcatagcccttgattggagcacctgcctcacgcaagttgctaagggaaataccaacaccaccaccgatacgggacaattgcagagcagagttgatagaacgtccgatcgagttcatatcgtcagtgacttgaatgaggaaacacgataccaactcaccacgacgggcacggcctgcgttgaggaaagacggtgttgctggctggtaacgaagatgaatcatttcgttggccaggtttagtgctaattcttcgtcgccctcagcaaaatacaaggcgttgaagagaacgcgatcttccatactttccaagtagtaagccccgtcgttggttttaagggcatactggttgtagaacttgtaagcagccatgaaagacttgaagcggaaattttggtctttcaagaattgatcgattttgatgataaattctggactgtattggtccaaaaactctttttcgaggtaattttcttctaatagataagcaatcttgtctaaaatactatcaaattgcttggtatttgggaggacgttttctgtaaagaaggccttaaccgcttcttggtccttgtggagaggaatttgtccattgacaggacggttgatttcgttatttaaacggaagtaggacacatcgcctagctcttttaaactcatagtcgcaatctctttctataaacagtagggagttaaaccaaggcttttagttttcctggttgaaaacctgagaaaacatcattttcagtttcgataacaggtgcagctgagaaaccgagaccttgtacgtgatcgataaattcaggctgttcatctagattgatttctttataatctacactatgttggtccaagaatttcttggtcattttacactgtacacaatcattttttgaatagatcgttaccattcaatttctcctttgtccatgagggattaataaaaaatcccaattttgttaccaatctaggatacaagattttaaggttaaagtcaagaaggaagtttatttaaaatcacaaaatatagtgcacaatattttcataagacaccatatattgtacatccgtccaatgctgccaagtcgaaaaatagcgtttacatagctgtttctatttagtttgataaccctaacaatctctcggtaaagtataaatcagcttttttacaaatgtcataatattttgaaggaaataaacgatgttacaaaatataacatttatggttatacatgtattgaatatatattaccttttgtactatactattcaataatgtcgaaagaggttataaaatatggaaaaaacacagagaaagcgcttgttttataaaggggaagaatattcatattatgcattggagtcgatttcaatggaagaaaaagtggatattcattcacttccctatactattcgtattttattagagagtcttttaagaaaagaagatggtgtggatgttacaaaaaatcacataatggagttgcttcattatcaggctgcctctcctaaaggggaaattccttttaaacctagtcgtgttattttgcaagattttacaggtgttcctgttgtggtagatttagcctccatgcgtgatgcggtggtgaaagcaggtggaaaccctgaattgattaacccagaaattccagtggatttagtcatcgaccactctgttcaagttgatttttttgggactgaagatgctctggagaaaaatattgccttagagttcgaaagaaataatgaacgctatgaatttctgaaatgggcagagaattcctttgaaaattatcgcgctgtgcctccagcaacaggaattatccatcaggtaaacattgaatttctaagcgatgttattatcaacaaggatggtttgctttatccagattctatgtttggtacagacagtcatacgaccatgattaatggtattggtgtacttggttggggtgtaggtggtattgaggcggaagctgcaatgttgggtgaagcatcttattttcccgttcctgaggtgattggtgttcgcctagatgggcaattgcctaaggttgccactgcaacggatttggcgcttaaggtcactcaacttctacgtcaggaaaatgtagttgggaagtttgtcgaattttttggaccaggtttatcttctcttacattagcggatcgagcaactgtttccaatatggctccagaatacggtgcgacttgtggctatttcccgatcgatggagaaactttacattatatgagattgaccaaccgttcggaggagcacgtggagttgacagaagcctatgctaaggctaattatttattctatgatgctgaacgttttccgtcttatagcaaggttttagaattggatttatcgacagtagtcccatctatttctggtcctaaaagaccacaggatttgatagaattaacagatgcaaaagcagagtttcaggctagtttaatacgtgaagtaggcgtgcgtggatttggtttggaggaagcagagttagataaaacagcctcggttaagtatgttgaaggagatgagcaaattcaaacaggtcatgttgctattgcggcgattacctcgtgtacaaatacctccaatccgtatgtccttttggcggcaggattactggcgaaaaatgcggtagaaaaaggtttggcagtttctaagacggtcaagacgtcattggcaccaggctcaaaagtagtgactggctatttgaaaaaatcaggtttgcagacctatctagataccttagggttcaatttggttggttatggttgtacaacttgtatcggtaactcaggtgatctgtgtcctgaagtggcggaggcgattaaggaagaagatttattggtttctgcggtattatctggaaatcgtaactttgaaggacggattaatccgttggtaaaagctaatttcttagcgagtccaccgattgtagttgcctatgctattgcgggaaatatgaatgtagatttaacaagggatccgctggggtatgatgagaagcaacaagctgtctaccttgcggacattatgccaagtcgtgaggaggtagacgactacattgagcgttatgtgactcgtgacctttataaggaagaataccaacaggtatttacagatagtcaggcttggaatgcgattgaaacaaaaataaataagaattacaattggaattcatcttctacctatattcaaaatccgccctattttgacaacatgcaggcagatttatccataaaaccactggaaaatttatctgttttggctaaatttggcgattctgtaacgacagatcatatttccccggcagggaatattgcacgattgagtccagccgctcgttatctcgaagagaatggcattgtttataaggattttaattcttatggaagtcgtcgtggaaatcacgaagtcatgatacgtgggacttttgcaaatattcgtataaagaatgagctggcagatggaaaaattggtggttggacaagagttggcgaagagattcttcctatctatgatgcggctatgagatataaggaagttggtgtcggtagtattgttattgctggtaaagactatgggatggggtcaagccgtgactgggcagcgaaaggttcaagtttacttggtgtgaaggctgttcttgctgagtcatttgagcggattcaccgttcaaacttagtgatgatgggtgttcttcctttacaatttttagaaggtcagtcggcagaaagtcttggcttgactggacatgaaagctatacaattgatttgccagaagatgtcggtgttggtcaaattgtaacagtccatgcgcaaacagacgatgttacaaaggagtttcaagctctggtgcggtttgatgcagaagcggatattcgttattatcgccacggaggtattttacctatggtagtaagaaagaaattaggaggaaaggtatgacagaaacgaatgggttaaaagatgcgattgcctgtgatacgcgaatcagtgcaattgaaaatgaccgcttgtcctatgcagggtatgacatcgctgaactgatggagaataacgcttcttttgaggaagtcatctatcttctgtggaacctgcatttgccaactcagattgaattaaattattttgagaaaagcctgcgaaaagaatatgcgatttcagatgcggtagagcaatgtattctgattcaatcacggcgacatttgcatccaatgagcgtgttgcgttcgacagtatctctccttggagtatataatgtacacgctgaagagaattcgttagaagctttgtatgaacaatctattcagattatggccaaggttccgacgattattgcaacatttgctcggttgagacgcggattggttccaattgaaccgcggtctgatctgggttttgcggcgaattttctttatatgctgaatggtgaggagccgagtgatttacaaatcaaagcgtttaacaaagctttggtgcttcatgctgatcatgaattgaatgcatctacttttgctgcgcgtgtcacggcatcaacgttaacggatttatattcttgtgtcaccacggcaattgggactctgaaaggctcattgcatggtggtgcaaatgaacgagtgtttgacatgttgttggctattcgtgagagtggtgataccgagagatatttgcagaagaagctggattcgaaggaaaaaattatgggatttggccatcgagtctataaaacggttgatcctcgccaagagtatttgaaggagatggcgcgtgatttgacattcggaacagacgatgaagcgttttatagattgtcagaggaagtagaaagctttattaaaaccaaaaaaggtttaattccaaacgtagatttttattcggcgacagtttaccatgtgctaggtattgatagtgatatttttacattgatttttgcaatgagccgtatggcggggtggattgcacatgtccaggaacaacggaaaaataataaattgattcgtccgcgctcttcctacttaggtggtaggaatttggtttacatcccgattggaaagaggtaaatatggcagaaaaaatcctaatgagagagggacggttaattgtcccagattgtcccgttattccctatattgaaggagatggtattggcagggatatttggtcagtcagtcaaaaagttattgatgctgcagtgaaaaaagcctatgcaggtcaacgttctattcagtggagggaggtttttgcaggagaaaaggcttatgaattaatgggaacttctttgccgaatgagacactggaaataattcgtgagcatttagttgcaatcaaaggtcccttggggacgccgattgggaaaggtcatcgttctcttaatgttgcacttcgtcaagaattagatttgtatgcctgtgtgcgtccgattcgctattttaagggagtgccaagtccgctgaaagagcctgaaaagacggatattactatttttcgtgaaaatacagaagatatttatgcaggtattgaatgggaggctggttcagatgaagttgccaaagtcatttcctttctgcaagaagaaatgggagtggtaaatatccgttttccagaatcttcaagtattggtatcaaaccgatttcggaagaagggagtaaacgcctcattcgctctgcaatagaatatgccctagaacatcaattgaagatggtgaccttagttcataagggaaatattcaaaagtttacagaaggtggcttccgcaagtggggttatgaattggcgaaagaagaatttgctacagaacttgcagaggggactttggtagtaaatgacattattgcggataactttctgcagcagattttattggcgccggaaaacttccaggtggttgctcttacaaatctaaatggagattatgcatcagatgctcttgcggctcaggtcggaggaataggcatctcaccgggtgctaacattaattatcagacaggtcatgctatctttgaagcgacacatggaactgctcctgatattgcaggaaaggatttggctaatccatgttctctcttgctttcggcttgtatgatgttggaatatattggctggaaagaagcggctgttttaattattcaggccttggaagacgcttttataaataaaaatgttacgcttgattttgctaaaattttggacgttgctcatcaatctactagtcaattttcagaagttctaatagattctatttaatgaagaaaaagtaaaatgaacctctctttttatgacggaaacatgaaagaaaggtaaaaaaatcttgaaaatgatttcaaaaagtggtataatgtcctttgtaagggttatcacaaataactcgcaattttgtaaaaataaaggagaatccaaatatggcttcaaaagacttccacattgtggcagaaacaggtatccacgcacgtccagcaactttgcttgtgcaaacagctagtaaatttgcttcagacatcactttgaactacaaagaaaagtctgttaaccttaaatctatcatgggtgttatgagtcttggtgttggtcaaggcgctgacgtaacaatctctgctgaaggtgctgatgctgacgacgcaatcgcagctatcactgaaacaatggaaaaagaaggattggcataagaatatgacagaaatgcttaaaggaatcgcagcatcagatggtgttgctgttgctaaggcatatctactcgttcagccagatttgtccttcgaaactgttacagttgaagatacaaatgcagaggaagctcgtttggatgctgctctagaagcatctcaaaacgagctttctgttattcgtgagaacgcagtagctagcctaggtgaagaggccgcagccgtatttgatgcacacttgatggttcttgctgatccagaaatgattggtcagattaaggaaacaattcgtgcgaagaaaacaaacgctgagactggtttgaaagaagttacggatatgtttatcgctatctttgaaggtatggaagataacccatacatgcaagagcgtgccgcagatattcgtgacgtagccaaacgtgtattggcacacttgcttggtgttcgcttgccaaacccagcaactatcgacgaagagtcaatcgttatcgcacatgacttgacaccttcagatacagcgcaattaaacaaacagttggtaaaagctttcgtaacgaacattggtggtcgtacaagtcactcagctatcatggctcgtacacttgaaattgctgctgttttggggacaaataacattactgaaatcgttaaagacggtgatgtattggctgttaacggtatcacaggtgacgtagtgattaacccttctgaagaagtgattgcagaatttaaagcagctggtgaagcttatgctaaacaaaaagctgaatgggctcttttgaaagatgctcaaacagttacagctgacggcaaacactttgaattggcagcaaatattggtacaccaaaagacgttgaaggtgtaaatgataacggtgcagaagcagttggtctttaccgtacagagttcttgtatatggactcacaagacttcccaactgaagacgagcaatacgaagcttacaaggctgttcttgaaggtatgaatggcaagcctgttgtggttcgtacaatggatattggtggtgataaggaacttccttacttcgatcttccacacgaaatgaacccattccttggtttccgtgcccttcgtatctctatctctgagactggtaaccaaatgttccgcactcagttgcgtgcccttcttcgttcatcagtacatggtaaacttcgtatcatgttcccaatggttgccttgttgactgaattccgtgcagcaaaagcaatccttgatgaagaaaaagcaaacttgttggctgaaggtgtagcagttgcggatgatatccaagttggtatcatgattgaaatccctgcagcagcaatgcttgcagaccaatttgccaaagaagttgacttcttctcaatcggtacgaacgaccttatccagtacacaatggctgcagaccgtatgaatgaacaagtttcatacctctaccaaccatataacccatcaatccttcgcttgattaacaatgttatcaaggctgcacacgcagaaggtaaatgggctggtatgtgtggtgagatggctggtgatcaacaagctgttccacttcttgtaggtatgggcttggatgagttctctatgagtgcaacatctgtacttcgtacacgtagccttatgaagaaacttgatacagctaagatggaagaatatgctcaccgtgccttgacagaatgtgcaacggcagaagaagttcttgaacttcaaaaagagtatgttgatttcgattaatcgttgaaaaaagcagggaattgaatccttgcttttttactgttcacaaaaagacttgtcggagcaagtctttttgtgtgcttagtttttctgataaaatttattgtgttggtagatagggtcaaaggtaagattgatgcctaatttacgaaggacactcttgtcttcatcagataggataacagtcgagtgggcttcgctaccatttaattggcctaattctttcatggcacgtgcagcaagagggctatcttgtgcagtgatggcaagggcgttaagaatctcacttgcatcgagtcgtgtattggtcttatccagataatctgccttcaattcttgaattggacggatgtagtttggttcgatgagaagtgtttcatcatcgatgttagcaatttgcttgatggcattgagaaggacagttgcagttggcttgaggaggtcggatgtcttacctgttacaatctctccagttggcaactgaatagcaagggcagggctagttgtcagctctgctttttcgcgcgcagcgataacaaccttacgatctgctggcgtcacaccgacttcattcatgaggagttcaatctttttaactgcttgctcgctcacccgctctgctttgaaatcaaccaaggtctggtagtagcggcggatgatttcttgcttggatgcttcgatcgcagcctcttcgtccacgatggaatagcccaccatgttaacgcccatgtctgtcggtgaggcgtatggtgatttgttcaaaatacgttcaaaggtacggttgaggacagggaagacctcgatgtcacggttgtagttgaccgcagttttgccgtaagtttgcagatggaaggggtcaatcatgttgaggtcgtccaggtcggcagttgctgcttcataggccaagttaacgggatggtggagtggtaagttccacactgggaaggtttcaaacttggcatagcctgatgttactccatgcaattggtcgtggtaaagttgggagatacaggtcgccaatttacctgaaccaggtccaggtgcggtgacaacgacgagattgcgactagtttcaatgtagtcatttttgcccataccttctggtgaaatgatgtggtcgatatcagaaggataacccttgattggatagtggagataggacttgataccatgtttttccaactgtttgcggaaggcgtctgcggctggttggttgcggtattgggtaatgaccacagaaccaacataaatatcaatatcattgaaggtgtcaatcaagcggaagacttcttggtcataagaaatacccaagtcaccacgtgccttagaatgttcgatgttgcttgcattgatggcgatgacgatttctacttggtcttttaactcttggaggagtttgattttgttatctggttcatagccaggtaaaacacgggctgcgtggaaatcttccaacatttttccgccaaattccatatagagcttgccttcaaattgggcaatacgctctaaaatatggtcacgttgcaaattcaaatatttagttgaatcaaatgcgatttttttcataaatatgtcctccaaatgtgtattaatctctgggaaaacaaaaaatagctccctaaaactagggagccttttctccgacctctcaaaagaggtgcccgaacaatactataacaaactgtgctaatcttgtcaagaaaaagtcagacagaagaaaaattaaacaagtgtttaaaaaaattagtaaattcccaaagtaagttctagtctgtcttaaaaactggaaattagactgagacaaagaaataaggtagaacttactatgggacaagttggtaactgacaatgaaaaacaaacacttaactctctctgatcgcaatgatattcaaataggaattgaacaacttaagcccttctcagctatagcagctaagttaggaaaagatccgtccacaatttcaaaagaagttcggagaaatagggtgataaaagagaactctagtacctccaattgtgaggcctgccctctactcaaaaagactccttacgtttgtaatgcctgtccgaaaaagagaagcaactgcggataccagaaacagttctactacgcaaaaagagctcagcttgattatgaagttaagctctcagattcgagaacaggtgttgcactaaacaaggaagaattctatcgcatggatgagattgtttctgctgccatccaaaagggacaacacctcaaccacatcatcgcctcaaacgaaatgtcggcatccagagcttctatctaccgataccttgaaaaaggctatctgtccacaaagcccattgatttcccccgtgtcgtgaaattcagaaagcggagaatcagaaacctacaacccattcctaaaatcgccaaagaaggacggtcttacgaggacttccaacgctttctcacagagaaaggaatcagctattggctggaaatggacaccgttactggacggatcggcggaaaggtacttctcacctttaacctctccttctgtaactttatcttcgctcaattacttgataataaaacagctaatgaggtcgctaaacatctctacgctatcaagaatgacctgcatcagaaagagatggacttttgcgaaatatttcctgtcattctgaccgataatggcggtgaattcgctagagtggacgatatcgaaatggatgttcgcggagaatctaagctattcttctgtgaccccaatcgttctgaccagaaggggagaattgagaagaatcacacacttatcagagatattcttcctaaaagaagttcttttgacaacttgacacaggaggacatcaacctggtttgttcgcatatcaacagcgtcaaacgagcttctttcaacggaaaatcagcctatgaactctttacatttacctacggtgaggaattggcaacacttttgggaatctctaaaattgaccctgagaacgtcattcaatcacctcgattattggataagtaatcgctagtttttatcaaaaaataatttcaaaatagaaaggaacttgttccatccaaaattccagatagctagaacttactttgagacgtctcagagccagtaactttagtgtactcttttttcaacattttcaaccctaaaactcactattatcaacatttttagtcaaaaacagaacttagtctgagactaaattctgttgatgttatgcagttttctcagagtaacttctggaaggacgggaactagaacttactttgagaatttaccgtttaaaaaaattaatttttataaaattaaatattgactttattgaaataaagtgtaaaataacattaaacaaatatttaattgatgtttaaggagacgtttatgaaaaggttgattcacaataaattatttctatctagctttgtggcagacttgatttccaactttggagatacgctttactatctggctttgatgaactatgttttactcttaccagataccaagtttgccctggctatgattaccgcatctgaaaccttgccgattttggcaggcctctttatcgggatttgggcagacaagaccaaaaacaaattggataccattcttgcaactctggtggttcgtgtcggtctctatgcctttgttggcttcttgatgggatttgcaccagccctctgggttgtggcggtggtctgcgtcatcaacttcctgtctgaccttgctggtcaatacgaaaacggtctctatatgccagtcagcttgcgggttgtggctgctgaagaccgtgaaacagctatggcttttaagatgacggtgaaaagtcttttgcaaattgccttccaagctagcggtgctatcctgatcggatttatgtcttaccagaatctcgccttcttcaatgcagggaccttcttggtcagtcttgctatcatggcaaccctccgtccagctcttgccaagctactgaaggaaaatccaatccaagaagctgagcaaacagaaacagaagcaggtattatcaagggcatgcgtaacagtctcaaagaatcctaccaagctgttcagaatattccagttctcaaagcgtcaattgtgaccattgccagcctgaatgccatttttaccgcactttcaccattagttattctaaatatgaaggagttctcagactttgtgattgtcaatgcaggaacaaccgttgctttgatttccattttcttctcagttggtagtatcttggggtcaagtatcggtatggctttgttcaaaaatgtcagcttaatcaatctcctcaaattctctacattgatgccagtcttgattttctcaggtttctttctccacaatatttatgtggtattgacgattatttttgtgacagctatgactttgggtgtcttcaatccgaaaatgaatgccttggtcttaaatgaactgcctgaagataaattggcgacagtcggtggagggattgatgctttctgccagattggtatggtagcaggtcaagctttagttgccctaatggtgacagtgctttctgcgacaagtatttctctcatcttcctcttgctttctgtaggactagtaagctatactattcttgtggggcgtaagtctaaaaatgaagtagttgttaaagcttagaaagtatgcgtatgaaattagattaccgagattatagaagcgagattgtcgaaaaattctttattcctttaattgtcaaggagcgtgaggaaccgattgaggcggatttttcacagaaagaaaaaggcattctcaaagataccttggacattcgtgatgagattgaagaaaagttggcagattttcgtcaagaagtcaatcaagtctttgtctggggatatatttttaacattttgcatagtctttatttctatatcttgaatgatgggcaggatccaaagacagttgaggaagcttgtcaattgattttaaagctgtctcaagaagaagtagaagatgccatgcgaaccatgttggcatctgaaaatgacggacatcgtgagaagaccctcagcctcatggaacttttggaaaaaacggataaaaagccggcagataagtggtactggtcactggctatccgcaatcccctggaaacagttgagcggtctgtccatctcttggataagatgcttccaatctaccagccctattttgagcaagcaagagttgagcgggaagcctttgctagggattttgacattgagaaactctatcgagactccaaacagttgtccatgactggcttggatgctttgagtgttgaaaatgctcaattcttcgttctcagtccgtggaattattggtttgcttattatggcaacgaagaatttgactatatgaaagtcgctcttttagcttcctgtcgaattgatcagattatgctgtcaaatgacgagctggatctggatgatttgacaacggctcttaaagtcatcagcgatagtacgcgctatcaggtcttggttgagctgaccaagcctcatgccaagagcaaggacattgcagaacgactggctattacaggggcggcagtgtctttccacactcaaaagctgattaacggtgacttacttctcttcaatacaaaaaatagcgatgtcaaatacagtgtcaatcgtgaacttctccaagaggtcattgccaaattgacagaggattttgatttgtaaaaaaagccttgtaagttagatcttacaaggttcttttgtgcttatacccttcgaaaatcaaaatcagacgttgttgacttgatttgatgagtgaaaaggtccagtggatcttttcagcctgttcccttgaaatataataaggaacagtgttctatctgcatcttacggtcacgaaccaagttcgtctaatttccgacctccaacagtctattgccagactgttggagctagtctgtttttgattttcattgagtattaatgattaaccagctgagcagttggcaagtgatgatggtgataaagaaaaccagccagccttgctgtattatagtcagggaatgattttctaggaagaaaaagctgatttcgactgggataacatggataaaataataatagctggcgtattcttttagaaattggaattttttctggcggaatagatctgtggttagggtccaggcgactagataggctgtgaatggaatcaggctaaatagaaagttcttgtcgtagccctgtttgagatagatgacagtggcttcaaaagctaaaagggctgtgcagacaagtagtttgtttttttgtcggtattggaaaatggggtgattgagtttgtcggctagataaaagcctgtcaggacaaaaatcggtgcgtagaagaggccgttgcggctggtgaaaaagaaggttttgtagctgtcaaatgcggtcaggaaaatcgattctgccaggtaggaggagtaggtttcgactgagcctagaagatagagaaggcaggctagacaagctgtgatgcgccagccccatttccttaaagaatagtggacaaggacaagacctagcaggaaggcgggcatgtaccagagttggtagctggtgcctgtgtaggtcagtccgactaggagtgcgagggggtagtggagtagggggatttcttggaggtttaggtagaagaggtagaagggtaggtagaggacggaccaggtcaggtactgcttgctgtagcggattaggtattgtttggagaggctggggtagttgcgtcggaggaagaagctggctgtgaccatgaagtagggaacgaccatgcgactaaagattgatttttggatgaagtggagctggtctgtttcaaataacctgcggcaatggagggcgataacgagaatggctccgatgaactggatgagggagagcagtgatgtattgagtggttttgtcttattttgcatgctaacgttcttcttttttcttctattttatcgaaatctgatgaatatgtaaatgtttgcaaaaagatgtggagaggtgctggctgaaacttagttgacaagagaagtccagtggaaaatatggtataatgttaggacggagtaaatgtaaactatctatttcgtttaagttagaaaggagcatatagatgaaagatttacatgcaaaattattggctgattttgggattgatttttcggatttgaatttattagaaacggcttttacccatacttcttatgccaatgagcatcgccttctaaaaatttcacataatgagcgcttggaatttttaggagacgctgttctccagttgatgatttccaaatatctttatcaaaaatatcctgatagacccgaaggtgagatgtccaagttgcgttcgacctttgtacgtgaggagtctttggctggtttttcacgtgcttgtggttttgatcggtttcttcgtcttggtaagggggaagagaagtctggagggcgaaatcgcgatactattttaggagatgctttcgaggcgttcttaggagctctgctattggacaaaggggaaaagaccgtggaggaatttatccataaggtcatgattcctcgtttagaaaaagggaattttgagcgcgtgaccgactataagactgctttgcaggaaattttgcaggtcaatggtgagattgctatttcgtatcaagtaatagctgagtctggacctgcccatgataagacctttgaagtggaggtatctgctgatcagcgtgtgattggtcgtggtcgtggtcgctctaagaaattagctgaacaagccgccgccaaaaatgctgtggaggctagaggataggtatgtatctaaaatcaattgaaatgcagggctttaagtcctttgcggataagactaaggtagtctttgatcgtggagtgactgctgttgtaggaccgaatggttctggcaagtccaatattacagaaagtctacgttgggccttgggagagtcgtctgctaaaagcctacgtggaggcaagatgccagacgtcatcttttcgggaacagaaagtcgcaaggctcttaactatgcctcggttgtcgtgaccttggataatagcacaggttttatcgccaataaacagaaagaaatcaaggtagaacgccacatttatcgatctggtgatagtgagtacttgattgatgggcaaaaggttcgtctacgggatattcatgatcttttcatggatacgggcttgggacgtgattctttctctatcatttcacaagggcgggttgaagcaattttcaattccaagcctgaggaacgccgtgctatttttgaagaggcggcaggggtcttaaaatacaagacgcgtaaaaaagaaacagaaagtaagttggcacaggcccaggacaacttggaccgcttggacgatattatctacgaattagataatcaggtcaaaccattagagaaacaggcacaaactgctaagaaatttctagaattagatggtcaacgtaaggaattatacttaaatgttttggtggctcagttgtcgcttggtaaggaaaagttatcggaaaaagaggccgaactagagtctgtcaaaactgaattgactagctactacaaacagcgttctgagctggagcaagaaaatctgaacttgaaagagaagcgccaccgcctttcagaacaattggagcgtgaacaggcagttctgttggatttgaccaagttaatcagtgatttggagcgaaaaattgaggtccataaactggaatctagtcaaaacgaatcaagtcgtcaagaagcgcaggcgcgcttggaaaacttgttgactagacgagagcagttggcagaacagattgagcaaaagcaagaaacgcttgcgcaattagatagttccttgtctagcttgaaagacgatattgctgcggtagacaaagaaatttcctacttttcagaagatcctgatcaggttttagatcatctgcgtgaacagtatgttgctctgatgcaggaagaggcagaagcttcaaacagtctgaccaagattcagcaggatattgccaatcaaatcagtctttcagagagtaaatctgaagacttggcacgcttgcagacggaaaaacaaacagctcaagaagtacttgataagagtcggaaaagtttagaagaagctgatcacgtgttacgccagttgcttgagagctatcagaccaaaaaaacagaattggatcaagtccagactgcttatcaggctgagcaaggtcgcttgtttgatttgctggatcagttgaaaggcaagcaggctcgtcagtctagtttagaagctattttaaaaaatcactccaatttctacgcgggggttaaggctgtcttacaggcggcaccaagcttaggaggaattattggagcagtcagtgaacaattgacctttgatactcgttaccaaacggctttggaaattgctcttggcggtgctagtcaaaacgtcatcgttgaagatgaagcgactgctaaacgagctatcgcatttttgaaagaaaaacggcaaggacgggcaaccttcttacctctaacaactatcaagccacgtcagctttctggacagcaagtctctttactagaatcttcagaaggattcttggggcttgcaagtgatttggtgacttatcagccaaatttagatgcgattttccaaaatttgctaggcactattgcgatttttgatagcattgaccatgccaaccaggcggcgcgtgcgaccaagtttcaagtgcgtatggtgaccatggatggagcggaaatccgtcctggtggagcctttgctggtggtagcaatcgaaataacagcacgacctttatcaaaccagaactggatgctcttttaggagaaatagcagagctgtctagccagttgcaggagcaagaaagcttggttgcagctaagaaaactagcttagaccaaaccagagaagccttggaaacgattaaggcggagggggaagaagctagattgaaccagcagagcgcaaggattcatcaggaacaggcagaaaatagactggctcagctatcagcccagtatgacctgcaaatgagtcaggttagtccgaccattttgactgagctagaagaggctgctgctaaggaagaagtaaatgtccaagccttgaatgagaaaaaactagccttggatcaacaaatcaatcaagtccgtgataatcgcgacagtattcaagaaagcttgcagaaactacagactcagaagggtcaactaactttggaacaagctgaactgactagccaacttcgttttgaacagacagatctgagacgtttgcaagaagaaaaagtggttgcagataaggaaatttctcttttagaggatatgattgaccagaagttagaagctcttgaagatactagcattgagattcttgaagaacaattgcaggccgcatctgataagcaaaaccagaccaatcagattctaattcgcttaaagtttgagttggaagatattgatgggcagtttgaagacttggaagaaagattgcaacaagctcggactaagaatgatgatttgatccgtaagcaggctaagttagaggcggattgtgagcaagcgggcgataaattacggactttacttggtaatttgaccgagcatttcaaattgagttttgaagctgctcagtctcaggccaaggaagttgagaatcttgcagttgctgaacaaagcctcaaagacctagaaagagctattcgtgctttgggtccagtcaatttggatgctattgagcagtatgacgaggtcaataaccgtctgaccttcctcaatgagcaacggacagatattttgtcggcgcgtgatttactactagatactatccacgagatggatgatgaagtcaaagagcgcttcaaggttacttttgaagctattcgtgaaagctttaagcagacattcaaacaaatgtttggcggtggttcagcggatttgattttgacagaaggtgacctattgactgcgggtgtggagatttctgttcaacctccgggtaagaaaattcaatctctcaatcttatgtcaggtggcgaaaaagccctttcggccctcgctctgctattttccattatccgtgttaagaccattccttttgtaattctcgatgaggtggaggcagccttggatgaggcgaatgtcaaacgttttggcgactacctcaaccgttttgataaggagagtcagtttatcgtcgtgacccaccgtaaagggaccatggcggcagcggatgccatgtatggggtgaccatgcaggaatctggcgtgtccaagattgtttccgttaagctgaaagatgtggagaaattatgattaacaaaatttacgccagtgatatggatggtacctttttacgagaagaccatagttttgataaggaacggtttcgtcgtatactgaatcagttcaaagaaaaaggttatttatttgtggcagcaagtgggcgatctatgcaaagcctgaaacttgtttttgaagattttgtagatgaaatcgggtttgtagctgaaaatggttcaatcgttgaatatcaggggcagactatctttatggatgatccaattagtcctgaaatttatctgccgattatcgcaggtattgatgcaggtccctttggtagcagtcgttccatggtgctgtctggcctcgaaaacttttatttattaaaaaatgctgagcctcagtttttagaagcgatgacgaattattacgcacattttcgattggtagacacatttgaagaagttcgagaagagattataaaaatcaatgccaaattttctcctgaggaaatggacgatgctagacgatggttaaatgatacatttgaaggtgtaacggccatgacaactggttttgacaatattgatataattccaaatggttcaaataaatcagttggattgagtcatctctgtgctcattttggaattacccgtcaggatgtagtggcatttggtgataatcaaaatgatttggatatgtttgactttgctggtctggctcttgcgacagaaaatgcaagagaggaagtgaaggcccaggcagattggatgattggtcattgcaatgatggagcagtattagcctatttagaggaggaagtaaatggcaattaagttgattgcattggatttagatggaacacttctgacatcggacaaacggatttcagaagctaataaaaaggccttgcaggcagcgcgtgagcgtggagtttatgtagttctgacaacagggcgtcctttacaagctatcggtacttttctagaagaactagatctgttaggggagaatcaatattcgattacatttaacggtggtctagtccaggaaaatacaggtcgagttttggataaggttggcttcaccattgaagatgtgcgcaccatccgtcgtgtgacaaatgacttggaccttcctctggatgttctctatggtggcgatgtctattctctaccatcagcccatgaatcactttatctaacttgtaatccattgcttaataaaattgtggcaagcgatgaggaaatgccagaagattttgtctacaataaggcagtttcagctgtggcagcagactttttggatggacaaattccaaaaattcctgcggaacttcacgagcgtttcgagattttcaaatcgcgtgatattctgctcgaatggagtccaaaaggtgttcataaagcaaatggtttggctaagttgattggacatctggggattgatcagtcagaagttatggcctgtggcgatgaaggaaatgatctttcgatgattgaatgggctggtctgggtgttgccatggctaatgcgactgatgaaatcaagtctgcggccaaccttgtcctgccaaaaaacaatgatgaagatggcattgcttgggtcatcgagcactatgtattgaatgaggactagtatgggattatttgatcgattatttggacaaaaaaaacaagaggagcaagtcgctcttgttgaagaagtggaaagggagcagtcggcttctagcgaagatacagtaactactgaagttgagtcagctactcaagaaatggaaaagttccagtctgaagtagcagagactgaattgacagccgaacaagaagctcagaaacaacggaccttagacatgatggctcaatattatgcagccaaagaagccgctgcggctcgagtgaaggaagcgcaggaacaaggctttgaccctgctattcaaaccaaggtcaaggaagagcctgttgaggaagttgctccagtagggcaagaaagtgaacaggacaagtaccagcgtaccttgaaaaagacgcgtacaggatttggggcaaggctcaatgaattctttgccaatttccgttcggttgatgaagaatttttcgaagagttggaagaaatgctgattttgtcagacgtaggtgtgcaagttgcttctacgctgacagaggagctccgctatgaagccaagctacaaaatgccaagaagatagatgaactccgtcgtgttatcatcgaaaaattggtggatatttacgaaaaagacggtcaattcagtgagcaaatcaatttccaagatgatttgacagtcatgctctttgtcggtgtcaacggtgttgggaagacgacgtctatcggtaagttagcctacaagtacaagcaagctggcaagaaggtcatgttggtcgcagcggacaccttccgtgcgggtgcggtagcccagctggtcgagtggggtcgccgtgtcgatgtgccagtagtcacaggacctgaaaagtcagacccagctagtgtggtttttgatggggtaaaacgtgccgtggcagaaggcgtggatattctcatgattgatacagcaggtcgcttgcaaaataaagaaaacctcatggcagagctggaaaaaatcggtcgcatcatcaaacggaccctacctgatgcaccgcatgaaaccctcttagcactggatgcctccacaggtcaaaacgccctcagtcaagccaaggaatttgcaaaaattactccattgactgggctagtcttgaccaagctagacggtacagccaagggtggtgtcgttcttgccatccgtcaggaactggatataccagttaagctaattggtttcggtgagaaaatcgatgacatcggtgaattcaaatccgaagaattcatgcgtgggctattggaaggattggtatagaaaaagtcgttagttcaatgaactagcgactttttctatctgtatgcagcagtgagtaaatggcaatatccacaataccccgattgtttcgagcggcttggcggagagttccttcataggtcataccgactttttccatgacacgaccagaaggacgattttcactatcgtgaacagctgtaatccgtaaacagcccacttcctccaataaatagtgattaacagcttcaagagcttcggccatataactttgcccccaccatttactgcccaacacccaacctaattcggcagcttgaactctttcatcaaggctgacaacggaaatatctccaatgggttgctgattttctttgagctcaattacccacctgtatgttttttcctgtgaataggattgaagacagaactggacatagtcttcagtatcttggagtgtctgatgcgttggccaggtcagataggtggtaaccttttcatctgaagtccagttttggaaaactgattcaacatcgcttgcttgaaaagggcgtaaaattagacgttctgtttctaaaatctgagttcctttatgttgcatcttatttcctcctcaacaacgcttctatccagtctggtgcataggcagaagtgcagccttttggaactttcatgttcgcatagacggccaattcctgaccaattgcaagaccttgttccaggtagtcaggataggtaactgcaatctccactaagcattggttcatggtccattggacaagcgggtcagcggtttgcaaatgctggcgaatatggtctagagattcttcgatttcttgatttgaggcagttcttccagcaaagtatttggcacgaaggaaccaacctaatcgttgaaaaatagcctggtcttggatgagtaagtattcttcccagtctttgctatccttgcgtttgctgaggataatggaagccaatttatcgaggacattgaccgaaatttgttcattgaggcaattctctaggtcagcttggggaagttggttaggtttagccttggcaacttgaatagctaaatattgtgcttctaggacacctgtttgccagagtggggcaaataagtccagtcgatttttataggccttggcgataccagaaatagctcccattggaactccgtagtagggcttagtttcgccaattttttcataacgcttgagggtgccagcatggctggctacttcaagttgggtgagaatgatgttcatttcagtcataaatatctcccaaaaaaactggattgctccagtttttatatgtagtcgtttagtttgcttttagtacaaggcaacgaggtgcaggttgctagaacagcctagaggctgttctaggttggaaataagacatgcgaagcaagtcactttcgtggagtacggcaaagcgagttaacgaagtaatcaaagctaaactaaatgactatttcaataaaccacgttcacgataccagacatcaggtgtccaaacccacttgcaactgtagctttctagcaaatcaaaggctgcctcaggtcccatagttccagctggataggtgtggagtgggacttggttgcttgcccacaaatcaacaatgcggtcaatcaagctccagcttgctttcacttcttcccaatggctaaagttagtagaatcaccatttaggacatcgaaaaagagtttttcgtaggcttcgggtgaatttccaagagcagttgcattgtggcggaagttgagtttggcaggagtaagagcaaaatgggaaccaacttccttaccgttgatagagagcatgaagccttcagttggttggatgaagatggtcaatacattggcttcggaaggttgaccaaaaatatcttccgcatgcttgaaggtgatggtcacgcgcgtgcccttttctgtcagacgtttacctgtacggaagaagaaaggtacatcacggaaacggtcagtatcaacgaagaagacacctcctgcaaaggtttctgtctgagaaccttcggcaatatttggttcatccaagtagctaacgtagtcttttccgtcaatggaacctgctgcatattgaccacggatgaagttgcgtttgaggtcctcatcagaaggctgacgaaggtgttggaagaccttaatcttttcagcgcggacatcttcctccttgaagctggctggcttatccattgctagaagggaaagaacttgaagggcatggttttgcaccatgtcttttaaggcgccagaatgatcgtagtagcctccacgatcctcaacaccaatcgcttcagcaaatgtaatttggacgttatcgatgtaatcgcggttccaaatatgctcaaaaatgatattggcaaagcgaaccgcaaagatattttgcaccatttccttgcctaggtaatggtcgatacggtagatttggtcttcattgaaggctgctgccaattcatcattgagtttggtagctgtagcaaggctagttccgaaaggtttttcaattatcaagcgttcaaaaccttgtccatcaacgatttgctcagatttgaggtgtttggcaatggttccgaaaaattcaggtgccatagagaggaagaagaccttgttgtgctgggtattgtatttttcacacaagtcgtcctgcaatttacgaagagctacataatgttccgtgtcattgacatcgtggctttggtagtagaaatgatttgcaaattcatgagcttgacgtggtgtgtcaggcagatcacctagtgattcaatgacggtttgctcaaaaaattccttggtccagggtctgcgagctgtaccaattactgcaaaattttctcggatatggcctgccttataaagacggaagagggatggatagagtttgcgtttggcaaggtcgccactagcaccaaaaattgtaaacaatacatgtgatgacataatttcattcctatctgttgaatatcattaatagtataccacaaattgtcagaaaattcacttttttagttggaattattagaaaacacggtagacatacggagaatctggctgctcaatctgaaccatcgattgtaattcaagtgttgggagattttgtttcaacgatgtgtggtaggaaaccttgattgttcctctggcttttacccaagtattgttaggaaattctgtggtagcccccgtagagagtaagccatataccccagaatcagcaatgcagtgaataataccaaagcggaaaaggaaaaattgctggctattgtcagggtcattgtagacaaatccaatcatttcaatcgtttttcctgaaaattccgtaggatagtcgtagattgcttccatcacttccatatagttttcattagtaacgacaatggtttcttcagccaagtatctatcagcaatttcacgcatctggttttgataggcagattttgtaaaataaatagaagtatcaggcttgagatactgaacagtcgccccttcttggttttgtgtattagtatcgttttctgttgctagtgggaaatgatagcccttggcagcaacagttgttgaatccaggcttaccgtaggaaagagccaggctatagcaagaggaatgagcaatagtccaatgcttgatagtttggcaattttgctttttaaatggctatgtactcgaatttcttttacccagacatacaattgtacgatggcaagtatgaaagataaaaccatggatagataggctagatagctatagtgcagattaatgtattggtctaattttccagagatataaagatacatggtcatttcaaagtaacctgcaagaattaaaaaacgaatcatactacacctccaagtatcagactatatcccaaaataacgagagtgatagtaatgataaaaccgactataaatttccctttgaaataatgtttcatcatgagcaagtttttaacatccaccatgggtccgataactaagaaagccattactggggcgaatccgaagctggatagtagtgatgcaccaataaaggcatcggcttcggaacatagggaaagaagaaaggccagcaacatcatcagtaaaatagctgttaatggactgtgaccgatggtagtcaggacagcggttggaatatagacttgtacgagactggcaaatagacaaccaaagactaggtaacgtcccgtatcaaaaaattcatcaatggcatgaataagtgcgaagccaactttttgccagctggttttatctgaataatcatgctggtgatggtcaaacttgcttcctttaagaattggtccttttacgaaaaaaccaagaatgattcccaatactagggatacaatgatggctcctagggctctatagagtgcgaaaagtagggaatttccaaaagcggtaaaggttgcaaaaaggacgataggattaatcacaggcgccgttactaaaaagggaacagcagtataactcggcacttttttctctaatagccgattgacaatagggacaataccacattcgcaagacggaaaaatgaagccgataaaggttccaaatagaatggcaagaaacttgtttttaggtaagagtttacgaaccttatctggtgttataaacacatcgataaaacctgaaataatagctccaatcaagacaaagggcaaggcttcaatcatgatagataggaaaatagcccccgcctgtaggacggaggtaggtaattgatcaagaccaagcatattattttttatcctgattcaagttgtttttctcggaatgttcttttgattttggatctggatactcaatttcttccaatttttcaaatgaagcaaattcttccagcatcttttctaaatcatcttgtcgtttataagttacagccatagggcacctccaaaaattttatataaacattatacattttttactaaaaattatctaaaggaatctgtttttattgaagcgcaaatatagttcgcaccctcaaatcatgatataatattcttatgaaaacaagaatatcagaattagttagcgtgctcaatcaatacgctaaagagtattatcaattggaccaacctagcgtatcagatgcagaatatgatacgctttatcgtgaattagtagagctagaaacggctcatccagaactgattttaccagatagtcctacccatcgggtcgggggaaagatgctagacggatttgaaaaatatagtcatgtttatcctctttttagtttgcaggatgccttttctcgtgaagagttagaagcttttgaccagcgagttcgcaaggaatttcctcaagcaacgtatatctgtgaattgaagattgatggtctgtctatttccctgacctatgaagcgggtaatttagtcgtgggtgctacacgtggtgacggtagtgtcggtgaaaatatcacagaaaatctcaaacgagtggctgatgttcctttgaccttacccgaagctgtggacatcactgtccgaggtgagtgttatatgccaaaagcttcctttgaccgtgttaacaaacagcgtcaggaggctggtgaagctgaatttgttaatccgcgtaatgcagcagcagggaccctccgccagcttgatacgggagtggtggcccagcgtggtctcgctactttcctctaccaagaggctagtccatctgaagcgactagtcagtcacaagtactggagaaactggatgctctgggatttgtgaccaaccacgaatattgcttggcggagtcgattgatgacacgtgggattttattgaaaaaatagcagagcgtagagatgatttaccctatgagatagatggtgttgtcatcaaggtaaatgatttagctatacaagaagaactaggatttacagttaaagcgccacgatgggcagtagcttacaagtttccagctgaggaaaaagaagcagaaatcttgtcggttgattggactgttggccgaacaggtgttgtgacaccaacggccaatcttagtcctgttcaactggcaggaacgactgtcagtcgagcaactttgcataacgtagattatatcgccgaaaaagatattcgtattggcgatacggtcattgtttataaggcgggagatattattccagcagttctgaaagtggtggacaagtatcgaaaagagcaagaaatcatgcccattcctagtcattgtccgtcttgtcagagcgacctacaacactatgaggacgaagttgccctccgctgtatcaaccctatttgtcctagccagctgatgagtaagttggaacattttgcaagtcgggatgctatgaatatcgcagggctagggtcttcaatcgttgaaaaactctttggagcaggcttggtacacgatgttgctgatatttataaattaactgttgatgacctattgaccttggaaggtttcaaagaaaaatcagctaacaagctctatcaagccattcaaacttctaagagtaactcagcagaatgcctcctatttggactaggtattcgccatgtaggtagtaaggcaagtaagattttagtagaaaaatttggtgatttagaaactctagcatttgctgatcaagaagcaattgcttcgctagaaggtcttggtcaggttattgctaagtctttgacaactttttttgctagtgagggtgcgcaacaacttttagccgaacttaaggaagctaaggtaaacttaacctatctcggccaagtagtagatgaaaatgctgcgctatcgggtatgacagttgtactgactggtaaattggagcgaatgaaacgaaacgaagccaaagccaaattagaagctttaggggcaaatgtagcgggatctgtttctaaaaaaactaatcttgtggttgccggaacagatgcaggcagtaaattgaccaaagcacaggagctaggtattgaaataaaagatgaggcttggttagagagcttgtaaaggtaaaacgatggaagaaagaaaacgtgctagactaatatataatccgacctcaggtcaagaaatcatgaagaaaaatgtggccgaagtattggaaattttggaaggctacggttatgagacttcagctttccaaacaactgctgagaaagactctgcaaagaatgaagctacacgtgcggcgcttgcaggctttgacttgattatcgcggctggtggagatggaacaatcaatgaagtcgtcaatggaattgctccacttgaaaaacgtccgcagatggccatcataccgactggcaccaccaatgactatgcgcgtgctttaaaagtgcctaggggaaatcctgtagaagcagctaaggttattggtaagcagcagacaattttaatggatattggtttagccaaaaatcaaaaaaatggttttcatcaagaacattattttatcaacattgctgcggcaggtacacttacggagttgacctacagtgttcccagtcaacttaagaccatgtttggctatttggcctatgtagtaaaaggagcagaactcctgccacaagtacaatttacacctgttcgtgtagagcatgatgagggcgtgtttgaaggctcggtttcaatgatttttgttgccttaaccaattcaattggaggttttgaacagatcgttcccgatgctaagttagatgatggtaattttaccttattgatggttaaaacagggaatctatttgaaattctacatctgattcgtcaagtcttagatggtggcaaacacattgagagtgatttagttgaatacataaaaaccaagagcctatccatcgaaaatctgaacccagataaccgtctactgctcaatctagatggagagtttggtggggaagcccctgtacgtctgtacaacctatcaaaccatatagagtttttcgcagatacagatctggtttctgaccatgcaatcactcttgatactgatcagatgaatcgagaagatatggccaaacgattcattgaagaaacagaccatattgatgaagctattaaataggaagaaaagatgaaatactcttttctttttattttacaaaaacgaattaaacgcttacaatggcggtattttcttgacaaatagatgttttaggagtatccttacatggtattaaattttaaaaggagaattcgttatgagtttaggcgcattggcccttggattggcctgtcttggtgtaagtatcggtgagggactgttggtggcttcataccttagttcgactgcacgtcaaccagaaatgcaaagtaaattgatggctggtgtatttttgggtgttgcctttatcgagggaactttcttcgtaaccttggctatgacatttgtcttaaaatagtagaaaatagagaaatagaaaaggggggaacctccattggaagaacatttaagtccaacccttacccttggtcccgtaacctttgacctgaccatggtattggtttctgtcattaccatttccattattttcttactagttttttgggctagtcgtcggatggagctcaagccaaaaggaaaacagaatgttttggagtatgtttacgaattgaccatcaattttacaaaagggaatcttggcgatgcggaagcaaagcggtattccttgttcttctttacagtctttacttttcttttggttgccaataatctaggtttgatgaccaaattggaaacagcagaaggacataatttgtggacttctccaacagccaatatggcttacgatttcggtttggcaacaattgcaacagtattttgtcatgttgagggtattcgtcgtcgcggtttcaaggcatacctcaaatcttttgtgacaccctgggctatggctccaatgaacattttggaagaagtgaccaaccttgtgtcgcttgctcttcgtctgtacggtaacatttatgctggtgaagtgcttgtctctcttcttctacaattatctcaacaaagtgcacttgcatatccaattgcctttgctctgaacgttgtttggacagtattttctgtattcatttcatgcttgcagggatatgtatttatcatgttggtatctatgtacttaaataaaaaaatcagtagtgagagtgaataggaaagggaaagacaactatggcaacaactattacaatgcaatctagtaccattcttggaaactttatcttggtaacagcctcatttgcagtacttattattcttattcgtgtttttgcatgggataaaattacaggtatttttgaagaacgtgccaataagattgcgaacgatattgatgctgcagaagaaaaattaacagcagcagcaaaccttgttcaacaacgtgaagatgagttggtacagggacgtattgaaagtcaaaagattattcaagacgcggttgaacgcgcaaaactagagaaaaaacgtattcttgagcaagcagatgttgaaattcaaggattgaagcaaaaagctcaattggaaattgaagctgaaaaacgtgaagcacaagaaaacttgcgtgttcaagttgctgaattggcagttgatcttgcaagcaaaattattttggaagatttggaccaacaagctcatagtaacttgattgaccgttatttggacaaactaggagacaagtagatgaacgctagagaaaatgccatcgtgcaaaaatatgctctatcatttgttgaaaaagtcagtgatcatgcagatatttgggatatgtatgaccagatttctgacttgatttccatcattcatgatagtaagctgaatcgaatcttgctgtcagcgacagtatcgagagaagaaaaggctgactttgtaaggacggtacgtcaatctagtttctggcaaatcaatgacttgattgaagatgttattcgtgatggtcatgcagacttgcttcttgaaacccttgagcgtgtccaattacaaatcagtaaatttaaaaatgaatttgaagcccgtgtggtttcagtctatccgttgacagaagctcaaaaagagcgtctccgtcacttggtagaacaacgattttccttgcgtgtacgcaatatcacggaagaacttgatcaaagtctcctcggtggttttattgtaacggttaaccataaggtaatcgatgcaagcgttcggacacagttgaaggacattagaaaaaaactttaaaaaatagaaagtggtgttcttttgattaatgcacaagaaattagcgctttactaaaacaacaaattgaaggctttcagcctgactttgactacacagagactggtgtcgtaacctatatcggtgacggtatcgcccgtgcgcaaggtcttgacaatgccatgagtggagagcttttggtatttgaaaatggcaccattggtatggcacaaaacttagaaaccaacgatgttggtattatcattctcggacaatttaccgatattcgtgaagggtcagttgttcgtcgtactggtaaaattatggaagtaccagttggttcggctttgattggtcgtgtcatcaacccacttggtcaacctgtggatggtcttggtgagattcgtactagtaagactcgtccgattgaatatccagcaccaggtgttatgcaacgtaagtcggttaatgaaccgcttcaaactggtctcaaggcgattgacgctttggttccgattggtcgtggtcagcgtgaattgattattggtgaccgtcagacagggaagacatctgtagctattgatgctattctcaaccaaaaaggccaagacatgatttgtatctatgtggctatcggtcagaaagagtcaactgttcgtactcaggttgaaacccttcgtcaatatggtgctttggattacacaatcgtagtaactgcatctgcttcacaaccgtctccattgcttttcttggctccttatgctggtgttgcgatggcagaagagttcatgtatgaaggcaaacacgtcttgattgtttacgatgatttgtcgaaacaagcggtagcttaccgtgaattatctctcttgcttcgtcgtcctccgggtcgtgaagcctatccaggggatgtattctacttgcacagtcgtttgcttgagcgttcagcaaaggtttcagatgaattgggcggtggctccattacagctctaccatttatcgaaacacaggcgggagatatttcagcttacatcgcgaccaacgtgatttctatcacggacggacaaatcttcttgaaggacgatttattcaactctggtatccgtccagccattgatgcgggttcttctgtatcacgtgtaggtggctctgcacagattaaggccatgaaaaaggttgcaggtacccttcgtatcgacttagcttcttatcgtgaattagaagcctttactcaatttggttcggatttggatgcagcaactcaggctaaactcaaccgtggtcgtcggactgtggaagtgttgaaacaaccattgcataagccgcttccagttgaaaaacaggttttgattttgtatgctttgacaaatggcttcttggattcagtgccaatcgatgatattttggcatttgaagaagaactgtacgcatattttgatttgcactacgatggtcttttggatgttattcgtacaacaaaagatcttcctgatacagatgaattgaatgctgctatccaagctttcaaagaccagtctgtctttaagtaaaggagtgaataatggcaggttctctcaatgaaatcaaatcaaaaattgcatcaactaagaaaaccagtcaaatcaccggtgccatgcagatggtttcggcttctaaattagccaaatcagagcaattagcgcaatcctttcaaatctacgctagcaaggttcgtcagattacaacggacctcttgcgtggagagttgatggcttcagatacaagcaatccaatgctgattcgtcgtccagttcaaaaatctggttatattgtcattacctctgacagtggactaaaaggttcttataattccagtattttgaaggctgtgatggggatgattgaacaggatcatgactcaaaagacgagtatgagattattgccattggtagtatgggagctgatttcttccgtgcccgtggtatcaatcctgtctttgaattgcgaggtttagcagacaacccaagttttgaagaggttcaaaaaatcatttctaagtctgttgaaatgtacaagaatgaactctttgatgagttgtatgtttgttataaccaccatgtcaatagtttgaccagtcaggtgcgtgtacaacagatgcttcctgtagaagatttggaccacaatgaagcagatggttatacagctacctttgagttggaaccaaaccgtgaggttattttggaacaactcttgactcaatatgcagaatcaactatttatggagcgattttggatgccaaaactgctgaaaatgcagcaggtatgacagccatgcagacagcaacggataatgctaagaatgtcattaacgatttgacaatccaatacaatagggctcgtcaggcagcgattactcaggaaattactgagattgtagctggtgcctcagcccttgagtaatagaaatagaggaaatagaatgagttcaggcaaaattactcaggttgtcggaccagttgtagacgttgcgtttgcagcagaagataaacttcctgagattaacaacgcactcgttgtatataaaaatgatgattccaaacaaaaagtcgtgcttgaagtggctttggaacttggtgatggcgttgtacggaccattgccatggaatcaacggatggattgacacgtgggatggaagttctcgatacaggtcgtcccatctctgttccagtcggtaaagaaacgctgggtcgtgtcttcaatgtgttgggagataccattgaccttgaagagtcttttccggcagattttgaacgtgagcctatccataagaaagcgccggcttttgacgaattatctacttcaagcgaaattttggaaacagggattaaggttatcgacctcctagcaccttatctaaaaggtggtaaggttggtctcttcggtggtgctggtgttggtaaaaccgttcttatccaagaattgattcacaatattgcccaagaacacggtggtatctctgtatttaccggagttggcgagcgtacccgtgaagggaacgatctttactgggaaatgaaagaatcaggtgttattgaaaaaacggccatggtatttggtcagatgaatgagccaccaggagcccgtatgcgtgttgctcttactggtttgactattgcggaatacttccgtgatgtggaagggcaggatgttcttctgttcatcgataatatcttccgtttcacacaggctggttcagaagtgtctgccctcttgggtcgtatgccatcagccgttggttatcagccaacacttgcgacggagatgggacaattgcaggagcgtattacctcaaccaagaagggttctgttacatctattcaggctatttacgtacctgcggatgactatacagacccagctccagcgacagccttcgctcacttggattcaacaactaacttggagcgtaagttgactcagcttggtatctaccctgcggtggatccattggcttcgtcatcacgtgcacttgctccacaaatcgttggtgaagagcactatgcagtagctatggaagtaaaacgtgtccttcaacgttaccaagaattgcaagatattattgccattctcggtatggatgaattatcagatgaagagaagaccttggttggtcgcgctcgtcgtatccaattcttcctctctcaaaacttcaacgttgcggagcaatttacaggtatgccaggttcttatgtgccagtagctgaaacggtgaaaggctttaaggaaatcttggacggcaaacacgaccatctaccagaagatgccttccgaaatgttggttcaattgaggatgtggtcgctaaagctgctaaaatgaaattctagaggtggcttatgggacaaatgactgtacaaatcgtaacaccagacggtatcaaatatgaccatcatgcagcatttgttttggtcaaaacggttgatggtgagatgggtgtctattctggacatgaagaactgattgcagttttggaaatcggtgaaatgaaagtgcgtcgtgttgatgatgaaaaccatgtagactggattgcggtcaatggtggaatcattgaagtcaacaaggatattattacggtcatttctgattccgctgagcgggaacgggatattgatattagtcgtgcggaacgtgccaaattgcgcgcggaacgtgaattggaagaagcacagactgctcgtaatattgatatggaaatgcgtgcaacagtcgccctccaacgtgcgataaatcgtattcgtgttgggaaacattaatctatatgggattgaacttggttcagttccattttttaatttcatggtataatggaaacatggtaatttcaattttacagttttttagtcatatattgtttatctatctggctcatcatctcttggttacaacagttgattggtcacggtggttgaaggtgactggggacaatcagcgtaaaatcaatttgctgattctctttctggcaatagcactggggtacttagtctcgactttctttttagaattgttgatgatgggacgctcttttgcaaatatgtgatttaagtaagaaaaggataagaaatggatacaattattattacaggtagtaaaaacggtttgaaaggacaggttgagattgagggggcgaagaatgccgttctgcctttattggcagcaacagttctagcaagtcaagggcaaaccaaattgacccaggttcctattttgtctgatgtctatacaatgaataatgttgtacgtggtctgggagttcgtgtgaaatttgacgaggaaacaaagactatcgatattgatgcaacaggtaaacttggtagtgaaactccttataagtatgtgagtcaaatgcgcgcctctattgttattcttggtccgattttggcacgcaatggctatgctaaggtttctatgccaggaggttgtacaattggtagtcgtccaattgatttgcacttaaaaggtttgcaagctatgggggctaaaattaaacaacgcgctggttatattgaagcgagtgcagagaacttgcagggagctcatatctatcttgatttcccaagtgttggggcaacgcaaaatttgatgatggctgcaactctggcgcagggtacaacggtattagaaaatgcagcgcgagaacctgaaattgttgacttggctattttcctaaacaaaatgggggcaaaagttaagggggcaggtacagagacgattacgattactggtgtagaagaattgactggcgcagaacatcaagtggtgcaagatcgtatcgaagcgggtacctttatggtggcagcggcaatgactggtggagatgtcttggtcaaggacgctgtctgggagcataaccgtccactcatttctaagatgttggaaatgggagttgaggtgacggaagaagctgaagggattcgagttcgttcgcaagtggataagcttaaacctgtaacagtaaaaaccttgccccatccaggattcccaacggatatgcaggctcaatttacagctctaatggcagttgcaatttgattctggctggtttggtcgctgaaggtgaaacgattgtaggtaaattaacgcacttagatcgaggttactatcgttttcatgagaaattagctgctttaggtgcaacgattgaacgtgtgagtggagaagatgaaaatggataaggataatcttagctatgttggtaaaaatttaatcttagtagcagttgttttgttgattgctattttggtgtttattttaggattaatggttggttacggtgtcataggagatggagacaatgtatttgcggtgttgtcaccagctaagtggcaagaattaatcggtaaatttacaggaaagtaggctggacctgcttttttgatggagagaaaatggcgaagaaaaatgtaaaaaaacaagcaatgagtctgctcagcttattggctacgattgttgtagtagcgggtggctatcttttaagtgataacaagagtagcaacgttgctgattattcctattatgtcaatcagtctaaggcaagtgaaggcacacctaatcaggaactggctagttcggtattgacagaagatgtaaaaaagcaactgggaaattcgattgaatggaatagtgctggagcgtttattattaacgggaatcaaacggatttagatgcatcggttgccagtgttccttatggtgataataagacaaaaacagtccagggagaaacggttccaacagtagccaatgcgcttttagctaaatctacacgtcagtataaggatcgtgaagaaacaggaaatggtcgaacttcttggacacctgcgggttggcatcagatccatgatttaactggagaatatgaccatgcagtggaccgtggtcacctcctaggttatgctttgattggtggattgtctggcttcgatgcttcaaccagcaatcctaagaatattgcagttcaaacagcttggtccaaccaagctaacgaccaaacttcaactgggcagaattattttgaaagtcagattcggcgggccttggataaaaataagcgtgtccgctatcgtgtgaccttggtgtatgctgagagtgaagaccttgttcctgtcggaagtcatctagaggcaaaagcagcagatggtagcctagagttcaatgtgttcgttccaaatgtgcagagtggtctcagtatcaactatcatagtggggaaattgcagtaaatcaataaatagtcagacgaattctccctcgttaaatcaaatatatcagacgattttcacgtaaaatcgtctttttttgcgtataattaaaaatatttacaaaaacagttgacaaatcatctgatgaatattagaatatagttaaagaaaacgcttacgactttgtcgtagaaaacatttaggaggaatttccaatggaaaaacatgttgagcaacgtgtcgaagacgttacttataacaaagccaagttatggcaaatcatattatttgcgatgaacaattcatcgacgaatatttacttggttgcttttactttcgtgacttatttatcgacaggtgtgcttggtcttgcagccctgtttgttagtcaactgatggggtatattcgtatctttgatggtttcattgatcctacaatcggagttatcattgataaaacggatactaagtttggtaaatatcgtcctattttggttttggggaatatcattacagcagcttctctttttatgatgttaggtttaagtggagttagcgagagtctccgtcttcctctattcatccttgttttgattatccataaaattggatattcacttcaacagacgattacaaaagcaggacaagttgcgcttaccaatgatccaaagcaacgtccaatctttaatattgttgatggtattgcgacaactgtgttgatgactggtagtcaggttgttgtgtcagggacattggttccaaaacatggtggtttcactcgaagtttcttccaagaattgttcctcggtgtagtagtaatttcagctgttctgggtattcttgctattatcggtatttgggagaaagacaataagaaatactttggtcttggtgagaagacacaagaaactaagttgaaagactactggaaagttatcaaaggaaacaaacctttgcaggttctttcaatctctgcagcttttgtaaaatttgttgctcaactgtttggagattccgttatcggggttatgctgtatggtattatcttcggtgactatgctctttctggtaaaatgtctatgctgttgattttgccaggtattcttgtaacagttggtgctgcgcaattggctcgtcgtaaaggtttacgctttgcctatattacagcgcttcaacttgggattgctggtcttgtgaccttggcagcgatgctcttttcagctaaaccaggtatgttggatttgacaaattggaatctctacacaatcggcttctttgttgtttatatcattgctcgctacgcatctagtgctccatctggtttggtattgacaatgggggcagatattacagactatgaaacttcagtatctggtcgttacttgtcaggtatgattgggactatcttctcattgacagactcaattgcttcttcatttgccccaatggttgttggatttgtattagcaggtattggttttggtaaagagtacccaaccgttgaaacagcattctcaacagatttgagaatggctttgattgtcctattgacagtgattccagcagtggtattgagcgtatccttgttcttgatgaaattttacaaactagatcgtgaagaaatggcacgtattcaagagaaaatccatgttatgaaagcggcaaaagatgaggaacgtgtgcgtgcgattgcgaaaaatgttccattatctgatatggattatgtagatgttactcaatataaggttgatcaatacgacgataaataatacaataacgacctagttggaggattccagctgggtctttcatctaggaggcggtatgaaaaaaatcttagcgtttggagaagttttattgcggctatctcctcctcattatcagaccctaacacaagctaccagtttagattgtcagtttggtggctcagagttgaatgtcttggccagtttagcacagttggggcattcagttgagttggtgacggcacttcctgaaaatgaagtgggaaagatggcagaacactttctctttgcacggcagattggacagaagcatctgattcgaaaaaaaggaaggctggggatttattattatcaaaagggcttctctcttagacctagccaggtgacctacgaccgtgattattctgcctttagcttatccaaggaagaagagtatgatttggaaggtatgtttgacggtgtcgattggtttcatgtcagtggtataacggtcgctttgaatccagatatttatcgactggcctttcgtttgatggaaatggcaaagaggcagggtgttaaggtttcttttgacttgaattatcgagaaagtttgtggtcttcttttgaagaagcgagggagaaattatctccttttgtaggtttagcagatatttgctttggtctagagcctattcaactcttcaatgaatctggaaaagatgtgaaggatgaattggggttgaagcgcccttatgaaaataaagaagtcttgttggcggtggttaaaggtctggcggagacgtattctttgcaaagtcttgcttttacccagagggaaatgacctacaataatgaatatttgctgaaagcatatttgtatcaagatggtattctttatgaaacggaaaaagaatccattcaagttttggaccgagttgggacaggggatgcctttacagcaggaattattttgggctatttgcaggaaaaaacgccacaggaaatagtcgacttggggatggctagttttcaattcaaacataccattgaaggtgatgtcaatgtcatcagtccgtcagatattgctttgctattgaaaaaagggtcacgtgaaataaaacgatagaaagaaggaaaaagtatgttgtatccaatacagacaaaaacacgctcagtttattctttaaatggaatatggaaatttaagcaagggaacaatgatgttcatactctgttagatacagatgaggtaatggttgtaccgagttcttttaatgatgttgttgttgataaggacaaacgtcgttttgtcggagataattggtatgaactgatggtagctcttccagtagtagctgatgatgaagagttagttgtacgctttggttcggtgacacatcaggctaaagtctatgcagatggtcagttaatcagggagcacaagggtggtttcacaccttttgaatgcttgattccgtcaaacttatacgacgctgatcaattccgtttgacggtttgtgctaataatgagttgaattacacaaccctcccagtagggaattatagcgaagaagtggatgagaatggtcaaattgtgaagaccgtcaaggaaaattttgactttttcaactatgctggtatccagcggacagttcatctctataaacgtccccaaaataggattgaggatattgttattcggacggagctaaatcaagatttgactcaggcggtagtgaatgttgatgtgaagacagttgggcagtacgattccatccgtatgtctattttagatcaagagggacaggaagtaggtcttcttgaaaatggacaaatggtcattgaacatccacgcctttgggaggtcttggatgcctatctctatactgctaaagttgaattagttgacggagaaaacttactcgatacctactcagaacaattcggcattcgtagtgttgcggttgaaaatgggcagtttttcatcaatggaaaacctttctatttcaagggatttggtaaacatgaagataccttcatcaatgggcgtggtttcaatgaagcagccaatctgatggatttgaatttgcttaaagatattggagcaaattcctttaggacatctcattatccctattctgaggaaatgatgcggctggcagatcgtttgggaattgtcgtccttgatgaagtgccagcagttggcctgttccagcttttcaatgcagccttgaatttgacaggggattctgaagaagcaaaaaatacttgggaagttatgcaaaccaaggaggctcatgagctggtgattgatgaattgatagcgcgtgataagaatcatccttctgtagtgatgtgggttgttgccaatgaaccggcagggcatgaaaagggagcacgtgcttactttgaacctctgattcagcgcatgagggacagagatccgtctaagcgtcctgtgaccttggtcaatattatgacagcaacgcctgataaggatgaggttatggatttggtcgatgttgtctgtctcaatcgttactatggttggtatgttgctcatggtgacttgaaggcggcagagaaagggctccgtcaagagttggagacttggcaaaaactttatcctgacaagccgattttgattacggaatatggtgcagatactcttccaggtttgcattcgatgtgggatattccttatacagaggaatttcaggtggattactacgatatgaaccattgcgtctttgattcaattccgaatttagttggtgagcaggtatggaattttgctgattttgaaactacagtcggtatcattcgcattcaaggaaatcacaaaggattattctcaagaaatagacaacccaagcaaattgtaagagaaatcaagaaacgttggactgccattccaaactaccattataagaggaaatgagctataatagtagcaaatagaaagttgtattggaggaccaagcacatggcgaaacccttggtagaaaaagcatcagagcgcttattggaattgattttggaaagaggatatgaagttggtgataagcttccaaatgagtatgaattggcccaagatttagaagttggacgttcgactgttcgtgaagctgtgcgaagtttggctactcgaaatattctggaggtgcgccaagggtcgggaacctatatcagctctaaaaaaggagtatcagaggatcccctaggtttttctttggtaagagaccgtgtgaagttgacgacagatttgtttgaagtgcggtatttacttgaaccgagaattgcggagcgtgtcgctcagtttgcctcggacgaagacattgctcgactagaagaaattgtccttgctattgaagaggctgttgctgctggagacacgaagcatctggagttggatgtaaaattccactgtatgctggctgagatgagtgggaatctggctatgacaagtctcatgcctgtcattaatcaatctattcatctaatcaatgaaaactattcaaatcgtcagatgaaatcggatagtttacaggcccacaggaatatcttaatggctatcaagcaacgtcaccctgttgcagcatatgatagcatgttagcacatattatatcagtaagacaggttgttttaagcgaatggttcgataaagatatgaccttgcatggtctcaacgatcataaatagaaataaaaaatagacagcccagaagaattcttctgggtattttttgcttttttattgacaaatcatctgatgaattgtatactatagctataaatgacaacgctttctaattggaggtcaagatgttaaagcaattaaaagaaaattactttttcgcagtgattcgcggaaaagatgaagaagatgcgaaagagatcgctcgccatgcgattttgggaggtattcgaaatattgaaattacattttcgactccaaatgcagcgacagttatcaaagaattacaagaggagttctcagatgattcatccgtagtcattggggcgggaacagtgatgaatcttaagctggcacaagcggccattgatgcaggtgctagtttcctggttagtcctcattttgataaagaaattcaagacttggcgcaagaggctgaggtattctacttcccaggttgtgcaactgcaacagagattgtcacagctagtcaggcgggatgtcctattatcaagcttttccctggtggtgtcttgggtcctggatttatcaaggatattcacggccctgttcctgatgtgaatttgatgccttcaggtggagtttcggttgaaaatgttgcagattggaaaaaggcaggtgcttgtgctgttggagtcggttcggctctggcaagtcgagtgcaggctgaaggctatgaaagtgtaacgacgattgctcgcagttttgttgcagctttggagggatgaaatgagttttaatgacaaaaactttatgctaaaaaacgagcctgctaaggagctttacgggaaaatagcagagcttcctatctatgatttccattgtcatctggatccgaaggaaatttttgaagataaggtttatgaagatattgttgatttgtggctggggggtgaccattataagtggcgcttgatgcgggctaatggtatctcagaagaagaaatcacaggttcagcaagtaaactagataagtttaaggcctgggcaagaaccttggaacgggctttcggaaatcctctctatcattggagtcatttggaattgcgacaggttttcggtgttgaggaattgttgaccgaagaaaatgcagagcgactctatcatcagctcaatgcttatttgcaagaacatcaagttagtccacggaagctgattgcggatgttagggtgacctttattgggacaactgaccatcctcttgatagcttggaatggcataagcgcttggctgaggactcgaccatagatactgtagtggcaccgactttccgaccagatgaagcttttatagaacatcgaaatttcaatccatttattaaacgcttggaggaggtaacaggggtagcagtaagagactttgcaagttttgtagaggcacttggtcagcgtgtttcctattttgctcaacacggttgccgagcaagtgacatcagttttacggctatttcctatgaagaggctaccctcgaagagttggatgaaattttactagcaagacttgcaggtaaagaagctggtcaatccagtatcaataaatggcagactgctatctttagagaattgtgccgattgtacaagaaacatggctttgtgacacaagttcacttcggtgccttacggaataaccataccggactgtttgaaaaacttggagcagatgtaggtgtggattcgattggagaccagacatgtctgactgtgaatttgaatcgtttcttagataacttggtcaaggaaaatgcccttccaaaaatgatttggtacaatctcaatccaagttacaacattgctctggccaatactttggcgaatttccagtccaatgaggaaggggttcgtagtcagctacaatttggtgctggttggtggttcaatgatacaaagttgggcatgattgaccagatgaatgcttatgcagaacagggcatgcttgccaatttcgttggtatgttgacagattcgcgtagctttttatcttatcaacggcatgattatttcagacgcattttagcgacctatgttggtcaatggattgttgatgaagaagtgccagaagattacaatcgtttagggcaatttgtagaagccatatcctattacaatgccaaagagttttttgaacaatagaaggagagtaaatcatgaaaatgtcatttcgctggtacgggaaaaaagatcctgtgacactggaagagattaaagcaatccctggtatgcagggaatcgtaacggcagtctacgatgtaccagttggtcaggcatggccccttgaaaacattctagagctgaaaaaaatggtagaagaggcaggacttgaaattactgttattgaatccattcctgttcatgaagacatcaaacaagggaagccaaatcgtgatgccttaatcgaaaactataagacttccatccgtaatgtcggggctgcaggtattccagttgtttgctacaatttcatgcctgtgtttgactggacccgttcagacttgcaccacccacttccggatggttcaacctctttagctttcctaaaatctgatttagcaggtgttgatcctgtggcggatgatttgaacttaccaggttgggattcgtcctattccaaggaagaaatgaaggctattattgaaaattatcgtcagaatatctctgaagaagatttatgggcgaatttggagtattttatcaaagcgattctgccaacggctgaggaggctggcgtcaaaatggccattcaccctgatgaccctccgtatggaattttcggattgccacgtattattactggtcaagaagccgttgaacgatttttgaatctctatgattcagaacacaatggaattaccatgtgtgtcggatcctatgcttctgatccgaaaaatgatgtccttgccatgacggaatatgctctcaaacgcaatcgtatcaattttatgcatacgcgcaatgtgacggcaggtgcttggggcttccaagaaactgcacatttgtcacaggctggtgacattgatatgaatgctgttgttaaattattggtggactatgattggcaaggttctttgcgtccagatcatggtcgtcgtatctggggagatcagaccaagacaccgggctacggtctgtatgaccgagcgctcggggcgacttactttaatggtctatacgaagccaatatgcgagcggctggcaaaacaccagattttggtattaaagcaaaaacagttggaacaaaggagggataactatgacgcgtgtcattgaatttaaggacaaggttgttgtcattacaggagcaggcggagtactttgtggttatttagccaaggaatttgctaaggctggtgccaaggtggctcttttagacttaaatcaagcagcagcccaagtttttgttgatgagattgttgcagcaggaggtagtgccaaggcttacaaatctaatgtcctttccaaggaaaatttggaagaagttcgccaacaggtattggcagatttcggtccggtagatattttaatcaacggagcaggtggcaataatccgaaagcgacaacggataatgagttccatgaagtgggtcttccagcggatacgaaaaccttctttgacctagatgaggcggggattaactttgttttcaatctgaattatctaggaaccttattgccaacacaggtctttgcacaggatatgattggccgtagcggagcaaatattatcaatatctccagcatgaatgcctttactcctttgacaaaaattcctgcctattcaggtgctaaggctgccatcagtaattttacccaatggttggcagtacatttttcaaaagttagtattcgttgcaacgccattgctccgggatttttggtaaccaaccaaaaccgtggtttgctttttgacgagtcaggtcaaccgaccgcacgtgccaacaagattttgaccaatacaccaatgggacggtttggtgaatcggaagagctagtcggcggcgtcttcttcttggcagatgagaatttggcaagttttgtcaacggtgttgttttaccgattgacggtggcttctcagcctattcaggagtctgatgatgaagatggaatacgtattttgtgtggactctgatggctgcgccatggacaccatgacctacaaacataagcttttcttcggccccttagctgcggaagtttttggtgttgaagataaagaaccgtttttagctgaatggaatcgagttaatctctactcacgagaacgtggcattaaccgttttgttggcttagttaaaggcctagaatttgcaggtgtgactggtatagacaacttgaaaaattgggtcgcgaccacagattctttgtcaaatgcttctctggaaagattgatagaggagcagccgtcaaaagacttggaattagccttaaaatggtccactcaagtcaatcaagccattaagcattatagtggtcctgttttagccttcatcggcgttcacaagggcttggaaaaattgagccagttaggaaaagtctacgtagtttcttctgctaataaggaagcagtagaagaagagtggacagaccaaggtttgatggactttgttacagaattgtactgtcaagaccgtggcaagaaagaagatgtcatcaaactgttaatagaggaagggtattgtcctaataagattatgatgattggtgactcgcctggtgatttgaaggcggcggaattgaatggtgtccatttctatcctattttagtaggacgagagatgcaatcttgggcagatttgacagaaacgattgcagatgactttgctcatcaagcattcacaggtgagaaagaaacagaattgatacaggcattttggaataatttagacgactagagaagggctagaggcgctatgccctctagcttttttggaggcaaacatgacacatttagtagatttacggaagaaaccttacagccttgatgaagaggctatttcttggattgaagaaaccattgctcagatgaccttggatgaaaaaatcggtcacctctttgtcaacatggggagccagcggacagaagactatctgactggagtattaaatgattataagattgctgctgttcgttacaatcctggacctgctgcagatatttgggagcaaaactatattttgcagaccaagtctaagattcccctcttgattgcagccaataccgaatctggtggaaatggcgctgttacggatggaacgaaaattggggatgaaatcaagattgctgcgacaaccgatccccgctatgcttatgaaatggggaaagttgcaggacttgaagcagctgcggtaggctgcaatgcctcctttgcaccgattatggacctaagccgtaattggcgcaatccaatcattgcaaaccgaacatggggagctaatgtagaccaagtcattgaattgtccaaagaatacatgcgaggcattatggaacatggcattgtgccgtttgctaagcattttcctggagatggtattgacgaacgagatcatcatttgtctttcgcttcgaatcccatgaccaagtctgaatggatggaaacatttggacggatttatggtgagatggctgacgcaggtctcccaggtattatggcggggcacattcatttgccaaatgttgagaaagaaatgcatccagaacgtgaattggatgacatgttgccagcttcgctgaataaaaccctcttggatgaattgcttcgtggagagttaggttacaatggtgccattgtcacggatgccagtcacatgatcggtatgacagcctctatgccgcgtcgtgagctattgcctacagctattgaggcaggatgtgatcttttccttttcttcaacgatccagaagaagatttgcaatggatgaaagaaggattggaaaatggtctgctttctgaggaacgcctccatgatgcccttcgtcgtaccttgggcttgaaagctaaactcggtcttcacttgtttgaaggtcgtcgtcaggaaatcatgttgccaaaagaagaagcactggctttgattggtagagatgaggcgaaacagcttgcaaaagaagtagctgacaaggcgattaccttggtaaaagccaaacaagaaggaattttcccagtcaatccagaacgctacaaacgtattttgttggtcgaagtagatggctataagggtggttttggtgccatgatcaatgctggcaagaagagagcagccgatacgctgaaagaactattagaagctcgaggtcaccaagtatctatctgggaaaatacggaggcacggattgccaaattgccagaagaagaaagaccagcagcgattgcaaatgtctatgcttccaagcgtccaattgcggaaatcacagataactatgatttgattatcaatttagttgatgtcaactcaggaggaacaactcagcgaattatttggccagctgccaagggaacaccagaccagcctttctatgttcacgaaattccaaccattgttgtctctgttcagcacccatttgcacttgcagatatgccacaggttgcaacctatatcaatgcctacgatggcttgcctgtcacattagaagccttggttgctaaactagcaggagagtcagcctttacaggagtatcgcctgttgatgcctactgtggcttggtagatacacagatttggcgcggaaaataaggaggaaagaatgcctagattggttgatttgcggaagaaaccctattgtttgaatgatgagcagattacctgggtagaaaataccttggctcatctgactgatgaagaaaaaatcggtcaattgtttgttaatctattcttcttcggaggagacgcttttagcggaaataatctgagtaatcaggaattgatgaatcgataccacataggtggtgcccgttatatgaatggcagtccagaacaggtacaaggactgattaacgagctgcaaagctattcaaaagtacctctcttggttgcagcgaactgtgactcaggtggagatggagctgtgaaaggaggaacctatatttcctcaggtgctcaatcggaagccagtcgggatcctcgtattccctacctagcaggtctcgtatctgcgcgtgaggagactgcattaggtgtaaatgtcaattttgatccttgcgtggacattgttcagaactggcgcaatactatcgtcaataccagagcctacggtacaaatgcggatgatgttattacctataccagtgcctatttagaaggattgactgctgaaagagatgttattcaatgtatcaagcatttcccaggagatggtaaagaagaacgtgatcagcacctagtcctaggcgtcaatgagctctctccagaagaatgggacaagagctttggtcgtgtctatcgtcatcatattgaagctggtgttgagatgattatggcgggacatatagccttgccatattaccaacaacgactcaatccaagtttgacggacgaagatattttgcctgcaacgctggctcctgaattgatccaagatttattgaaagaaaaactggaattcaatggcttggtcataacagatgccagccacatgttggggatgacagcagccatgcgtcgtgaagactacgtacctgcagccattgctgcgggttgcgatatgttcttattcttcaataacttagaagaagattttgaatttatgctcaatggctaccgcaagggagtgattactgacgaacgccttcatgatgctctccgtcgcattttaggtctgaaagccaaactcaatctgcatatcaagcaagcggaaggaaccttactaaaatcagctgatgaattggctattatcggctgtgaagaacacttggcttggcaacgtgaggcggcagacaaggcaattacgctgttgaaagatacacagaaaaatcttccaatcagtccagaaacccatcgcagaatccgattgtattacctagaaggtgaaaaagaagggattatggcggcaagtacagaagtggttgataaccttaaagctgccttggaagcgcgtggctatgaagtgaccgtcaatgatggtacgactcggatcaaaggaaaaacgctgcaataccgagaagaagttgatttagccttgactgttgccaatgtcattggatatgcagcgcagaataattaccgcatccagtggaaaacggccatgtcaaatgaagttccttggtatgtacatgaagttccaaccattttcatttcactaaactatacaactcaccttcacgatgttaccatggtcaaaactgctatcaatgcctaccatcacaataaaaatactatcgaatccttacttgataaattagaaggaaaagacgcattctttggtgtgccaaatgagaatgtttgggccaataaatggcaggcaaaactataaaactaaactcctttctatcctagatagagggagttttctaggaagatttcttgccaaactttcttctttttgataaaatatccttaattgaatagaagtctgtgagactagtacaccttatggaagctgtccagggagttgagccgtgactgcaagctcaatcagtgaaagttggtcgaattcactcacacaaggacttagaacctgcattcacagttcaacacttccatctaaggctagtttttcagctactcatcgttagtttttttcaaaatacagtcagtattccctcaaaaaacagccttgattagcggaaaaccatctcttatgtgcaagcacttcacttgtgaatataggttcatagaactaaggtctgccttgcagatgaaaacggatggtaccgcgtgacaacgctccgatacgagtggtgtcatgcgttttttattggaggaattatgtcaaacattgaacaacagttggctgaattaagccaaacgacactagaaaagttaaaagaaatccagcaccaaggagaaaaagaactacaagacctgcgtgttgcggttttgggtaaaaaagggtctttgacggacttattgaaaggcttgaaagacctgtctaacgacatgaaaccaatcgttggtaaacaggttaatgaagtgcgtgatgtgctgacaactgcctttgaagaaactgctcaaaaggttgcagcagcaaaaattcagcaacaactagcttccgaaaccattgatgtgaccttgccaggtcgtcaggttaaggtcggaaaacgccatgtcttgatccaaacttctgaagaaattgaagatattttcttgggcatgggcttccaaatcgttgacggatttgaagtggaaaaagactactacaactttgagaggatgaatttgccgaaagatcatccagcccgtgatatgcaagataccttctacatcacagaagaaatccttatgaggacccatacgtcgcctgttcaggcgcgtaccatggaccagcatgatttctcaaaaggtgctttgaagatgatttcgccaggacgtgttttccgtcgtgatacggatgatgcgacccacagccaccagttccaccagattgaaggcttggttgtcggtgaaaatgtatccatgggcgatctcaaaggtacgcttgaaatgattatcaagaaaatgtttggtgaagagcgtcagattcgcctgcgtccatcatacttcccattcactgagccttctgttgaggtggatgtttcctgcttcaagtgcggtggtgacggctgtaatgtatgtaagaaaacaggctggattgaaatcctcggtgccggcatggtccacccgcaagtattggaaatgagtggtattgactcaaccaagtactctggctttgccttcggtcttggtcaggaacgcattgccatgctccgttacggtatcaacgacatccgtggtttctatcaaggtgatgtacgattctcggagcagttttgatgtgagacctgtttctgatactgaaagtatctagaaacaggacggtagccgctatggcggtctacctactcccctcactaggttcaaggttgaaaaatatgtcgttttcaaccttgaaccgtcgtaatctcgcactatttaaggtgtgggtatcgttgctctgcgactttcctagtccagttagaaatgagaggcaatgagatgcagattgatcctatacgtttggaagaggtttccgttttgcaggagttggccaagcagacttttgcagagaccttcgctcacgataatgacccgaaggaactggaggcattctttgaggaatcttattccttggaggtcttgactagtgagttatcggatcccaactgccagcactattttctaagaatagatcatcagatagctggttatctcaagctcaacaaaggttctgcccagacggagcaagagttggaaaatgcctttgaaatccagcgtatctatctcttgcaggcctatcaaggtcgcggtcttgggaaggtcttgtttgaatttgctttggaaaaagcagagcagtctagttgtgattgggtctggctgggagtttgggaacataattacaaggctcagaaattctattccaaatacggatttgaaaaatttggccagcatgaatttgcggtcggtgataagattgatgtggattggctactgaaacggcctttgcaccagaaaggataatatgttagtaagttacaaatggttaaaagaactcgttgactttgatgcgacaagccatgacttgtctgaaaaaatgtcaacaacaggaattgaagtagaaggggttgagcaaaagagtgctggcctttctaagttggttgtcggtcaggttgtgtctgctgagccaattccagatactcacctcaatatttgtcaggtaaatgtgggcgaagcaatcacgcaaattgtttgcggtgctccaaatgtcaagccaggtatcaaggtgatcgttgctctgccaggagctcgtatcgctggcaactacaagattaagaaaggcaaaatccgcggagttgaatccttgggcatgctctgctcattgagcgaaatcggcgtgtccgactcagttgtgccaaaggtctatgcggacggtatctaccacctgccagaagatgcagtcgtgggtgagccagtcttttcatatcttgacctcgacgacgagattattgagttgtccatcacaccaaaccgtgccgacgccctctctatgcgtggtgtggctcacgaagtggcagctatctatgacagcaaggtcaacttcaagccagtggtcttggaggaaagcgacaagaaagccagcgatgtgattgaagtggccattgagtcagacaaggtgactgcctacacggcccgtgttattgaaaatgtgactatcgcaccgagcccgcagtggttgcaaaacctgctcatgaacgcaggtattcgcccgctcaacaatgtggtggacatcaccaactacatcttgctctacttcggtcagccaatgcacgcctttgatttcgataaatttgaaggcaagaaaatcgtggctcgtcaggcaaaagagggtgagaacttggtaactcttgacggcgaagaacgtgacttgattgccgatgacatcgtcatttccgttgcggacaaggcagttgccctcggtggtgtcatgggtggtgctaatacagagattgacaatagctctaagaccgtcgtgctggaagcagccctctttgacggcaagtctatccgcaagacctcaggtcgcctcaaccttcggtctgagtcctcttctcgctttgaaaaaggcatcaacgtagcaactttgacggaggctatggacacagcggctgctatgattgcggaactggctggcggtcaggtcttgtctggcatcgtttctgcgggcagcgtggacacttcggatgtcccagtcacagcaaccattgattacgttaaccgctcgcttgggaccaacctcgactatgcccaaatcgcagatattttccgtcgtttaggtatggaaacaactggcgatgcaagtcagtttacagtagcagtaccgcgtcgtcgttgggacattcgcattccagcagacttggtagaggaaatcgctcgtatctatggttacaataatctgccgaccactcttccgaaagaggacggaacagcaggcgagttgaccctgacccagaacatccgtcgccaagtacgtagcctggctgaaggtgcaggtctgacagaaatcatttcctatgccttgacaacgcctgacaaggctgtggagtttgtggctcgtccaaccacagtcaccgaactcatgtggccgatgacagttgaccgctctgccctccgtcagaacatggtgtctggtatgttagacacagtggcctacaacgtggctcgtaagaacaagaatttggctctttacgaaatcggtaagatctttgaacagtctggcaatccaaaagaggacctgccacaagaaatcaacaagtttgcccttgttttgactggtttggttgctgagaaagacttccagacaccagctgtaccagttgatttcttccatgccaaagggattttggaagctatctttgatcattacaagttggcagttgactttgtggcgactagtgagattgctgccctgcacccaggtcgtacagctgaaatccatttgaatggggctgtgatcggctttgtcggtcaggtacaccctcaaacggctaaggactacggtattcctgaaacttatgtggctgaaatcaatctggatgcgattgaagaagccctccagcctgctcagccatttaccgacatctctaaattcccagcggttagccgtgatattgccctgcttttgaacagcgatgtcaaacatcaggatgtcctggatgccattgctggtgctggcgtgaaacgcttgaccaaggtgactctctttgacgtctatgctggcagcaatatcgaggttggtaagaagtctatggcttataacctgaccttccagaatcctgaggatagcttgacggatgaggaagtggctaagtacatggagaaaatcagtaagtcgctcgaaacacttggagctgaaattcgttaacatgtaaatcttgtgaaatcctagtcagcgggctgggattttttggagggaagtatgaacactcaagatattcaagaaaaattttttcgagaaggcaagcttatcgttattcctaaaaaattaaaaagtaagcaagttttatttgcctatttacaagaagagttggctaagaaaggctctaccttcacagaaaaagaagtcaatgcctttctagctgaagtctatgatgattatgctatattgagacgctacttggtggactacggctacttgtcgcgtgaccaatatggtttggaatacagaatagaagaaaagagatgattgcggtcatctcttttgtcttacaaaataaagggttcaatcttcaactctatctggttgccatacttggctagtaaatcgtctgccaggggatgatagagttctcgtagttgttcgatcttgtcaggaaattgtttgccgatgtagtcaaacttgcactcgatggttaagaaaagttggtggaagagttcgttaatctcattcaagcgggcaatcatttcttcgtcttctttgagaaaatcagggatttctgagcgattgttgacaaaaccgtcgatgagttttacggggaaagagccgtattctaggacaaattcgtacatgggtttctccttgccttactattgataggactattgtagcatagattagaatgtgacaaaagaatttcaactttattgcagtttaagttttgtttaattttattttcagtttcatttaaagctaggtcggtaaactatatcttgtaaacaagacagggacctgtcaaaatttaggatagaagaggcacaataatgaaaacaagaatcgtacaaaagcagtttaagcgtaaagagactaaatatatcgttgataaaaaacttttgaacttttagaaaaggaacttcgtcagtacatgatggcagatgagtttgcgacatcaacgattaccaatatctactttgataatgaagattttgatatgattcaagattcacttgccaaaaagaatggacgtgagaaaattcggatgcgtgtctatgatgcgacaccatctgaatcgagtcaagcttttcttgaaatcaagaaaaaagaaaataaaattggctataaataccgtttaacttcaaaccctgtttctgtagcaaattatatcgaaaatggagtgattgattccacaatcaaggatgataaggtaacctcagaactcgaaatgttgagagaacgctacggtactattaagccgaagatgtatatctactacgatcgcgtatcctataaaggaatcgaagacaaaaaagttcgtctcacaatcgataagaacttactttatcgagactacgatgtggatgcaatggaaggtaaatttggtaagaacctattagacccaaccaaagtaatcatggaagtaaaagttccagaagaacgaccagactggttggtagccctgctcgaaaaataccaaatcgaaaagcaatcattttcaaaatatggcaatgcctataagcttgcccacaacatcactggagaggaagtaagcaaacatgcagctgtttaatagtatcttttcaacggccaatagcaatattaccttagcgcaaatgtccatggtttttggagttagtctatccatgggggtactcttagcggctgtttataaatataaatctaattatacaaaggaatttgtcatcacactaagtctgatgccggcattgattgctgttatcattgcattagttaatggtaacttgggagcgggtgttgcggtagcagggactttcagtctaattaaattccgctcagcagcaggttcttcgaaggaaatgcttgcagtcctcttagcgatggctatcggtctagcgacaggaatgggcttcctaggtttggctgtctttatgacggtcatcctatctgcttgtattttgatttttgagaacatcagctttgctcaagtcaatcaaaatcgtcgtcatctcttggtaacagtgccaatgaattttgactacgaccaattttttgagaaacaatttggtacatcctgcaagcaagcggatctcatttccctcaagtacaagaagaaaaaagaagcgctgatcttagaatatcaagttctcctcgataaaaaaattacagataaacgcttggtagatacagtattgtcagccggtcctttggatgtcgtattgaacaagcaaatgccgaagaagaagtatttgtaatatcaaagaagccctggatttccaaggctttttcgttttttattagcttattcttcataaaaatcaacgctataatcaagcaatttgtccccatcatagcggaagcaagcggaaaaaaatggtttgtcctctaatagccattcttgaaaatgccggtcgccctcccaagttggtttggacaagacttggtcatagggaacccactctaagtcaccttcattgcagtcaataagacttccttcaaaaccagttatcttaaagacataggtgtaccagtcagtgtttggagtaaagtctgggaaggttatcactccttttagagcatgcttcgttacagtaagcccagtttcctcaaagatttctcgaatggcacaagcctgcggtgtttcaccgggttccagcttaccaccgaccccaatccatttcccctggtggacatcgttttcttttttattgcgatggagcaggagaaattctttgccattatcaatgtagcaaatcgtagccagttggacaggtttcttggtcatagtagctccttatagttagtttgttcctattatatcacaaaggcgggagtagggacacctgcttggtgctctggtaggggacagttttgggattagcatactgaaagctcttttctgaaaacagtttttgaggtataataagaacatcaaactatttaggatgcactatgtcaaaacaagaacaaatcgaacaaacaatttatcaattattggaattattgggtgaggacccgaatcgtgaaggtttattagatacgcctaaacgggttgctaagatgtatttagaaatgtttaacggcctagaagaggatcccaaagaccaatttacagctgtcttttcagaaggtcatgaagaggttgttttggtcaaggatattccttttcattctatgtgtgaacaccatttggtacccttttatggcattgcccatgtagcttatattccgagtaaggggcgtgtgacaggtcttagcaaattggcgcgtgcagtggaggtagcaagtcgtcgccctcaattgcaggaacgcttgacccatcaggttgcccatgcccttcaagatgcccttgaaccagaaggtgtttttgtcatggtcgaagcagagcacatgtgcatgagcatgcgtggtattcgcaagccaggtagtaagacagtgaccacagttgctcttggcaaatacaaggaagatgccatcttgcgccgtgaactcttgtccatgattcacaataaataggaggttctatgtcaatcgaacagttagcgaatcaagtaaccattatggggattctcaatgtgacgccagattcattttcagatggtggtcactataatgaggtggagtctgccttggtacaagtagaaaagttgttggctgagggtgctaccgtcattgatgttggtggtgagtccactcggccaggtgcaacatttgtgtctgaagaagacgagattgctcgcgtggttccgattatccgcgctatcaaagaaaactatgactgtcttgtcagcgtcgatacctataaaacaggaactgcacgtgcagccttggaagcaggcgcagatattttaaatgatgtctgggcaggactttatgatggagatatgttggccctggctgcggagtacaaggtaccaattattctcatgcacaaccagaaagacgaaagctatgcggatgttgttggagaggtcaaaaactttctagctgagcgtgcccaagcagcacttgatgctggtgtttccgcagaccagatttggttggatccaggatttggcttttcaaagaatgtccaacataaccttgatctcttacaaggtttggaacagattactgcccttggttatcccgttctatttggaatatctcgtaagcgcgtggtggattatctgcttgggggcaatagtttaccgactgaccgcgatcaagcaacggcagccttgtctgcctgggcagtccaaaaaggctgtaaaatggtccgtgttcacaatgtcgctgccaaccgtgatatcgttaaggtttgggaccaattgacttctggaggtcaacatggataagatttctctcaataaatgtcgcttttacggctaccatggtgccttcaaagaagaacaagttcttggtcaaattttcacagttgactgtgatttgtttgttgacctgacagcagcttcacaaactgacaatttagaagacacagttcactatggtatggtctttgaaaccattaaagcagttgtggaaggcaagccctatattctcattgaaaaggtggcaggtgtcatctgtcaggagatttttgatcaatttccaaaggtggagaagattcgcttggccatttacaaggaaaatccgcccattgctggacactatgattctgtcggaattgaattggagcgtgaacgaccatgaagcatctagcctatctcagtatcggagggaatatgggcaatcgacaagcctatttacaggcagccctagacaaattagccagtcatccaggttgccagcttggcttagtttccaacatttatgaaactccagcttggggcaagaccgaccaggctgatttcctcaatctagcctgtcaagtgtatactgatttgtctgctcaggattttctaagcgttttccagaacatcgaacaagagttggaccgagtacggattgaaaaatggggacaacggaccattgatttggatattattttttgggatgaggagaagattcaagaagagaatctgattgttccccatccctacgcccatgaaagagcatttgttctcaaacctcttgctgagattgcttctgattactgtcacccaattttgaaaaaagtggtatcggacttgcttgcagaactaggggaacaaaaagatataaaaattttcaaatagttgcctctgatactaggtttattagaggatagaatagataaaggagttttatgacaattttagcaactttaggagttttattggctattgtagccattatttattggacatcaaaaaatttacatgttatcattgctgcaccactcgctagtttaatcatcattctgaccaatcagatgaatgttttggaagttatgttgggcaaagagcagtcttatatggcgggcttagcaggttttttgattaataattttgccatctttatgttggggtctatcttggcacgttatatggaggcaagtggagctacgcagacgatcgccaatagcattttgaaggtaatgggaaaggatagtccctataagggcttgttagctatcactttgattgcttccattctgacctatggtggtgtgagtatttttgtagttatttttaccttgcttcccctttcacgccccctctttaaagagttgaatatcaactgggcactttttccgattcctgtctttttgggagcaggtacctatacgatgacaactcttcctggggcaccttccatccagaatgtcattccgacaaaagttttgggaactagcttgaccgcggcacccattatcagtttggcagccagcttgacactattagtatttggcttgctctacatggcctactgcctcaagaaaagtctagcaaatggagagacgtatacggaagaagaggatgaaactgcagtagtggtagctgataagacaccaaatctatttttatcagtcttgcctctattcagtcttattgggacgattttcctaatgagtaaaactccgaatgtcctggcaatcggattgttggtctctatccttctatcagccttgattttttatccatatctgccaaatcaaaaagaaattttgaatgctgcgacaacggcatctatagtgcctgcttttgcaacttctagtacagtagcctttgggactgtgttaactttgtcagcaggttttgcagtcattcaagaatggattcaacaaataccaggatcacctctaatcagtttatctgtttcgacagcattgattagtggtattatcggttcatcttctggtgcgataggtattgcttcaagtaatttccttccttcctatttggaaatggggattaatccggagttgctgcatcgtgtagtagtagttgcatcggctattttgacagttatgcctcagtctggtgtgatgattaccttccacaatctttcgaaattaagtatgaaacgtggcctcaagtattcgtttatcctagtgacagttgggcatttgttagcattatttgtgattttactgttggcacctttgctatattaggattgattaacaaacaaataaaagccctgccaatgggcaatatcattcagttaaaacctctactcaaatatttattcgggtagaggctttttctttataatataataatcaatgaaatcccaaaacagtaagctctaatcttctatagttatttagcttttatcatatactaaacaaaaactaaataactacaaattgagtataaaagactgataatagcttaaaaggaaggttaaaaaataggaattctccctataattcagggaaaattcctattttttattatggattatgcaaatcagagcttttttcagtagcttcgatctgagaggcttgtttctttgaaatctggtggaaaataacagtccaattttcatgacggcgccaaagtgacgtatgaacataatcaccaatttcaaacgtaactaattttgatttttggctaatggaggtcatttggtaattggataaatacgtggtttggatggggtggtcggcaagcatctgagttttatttcgatagcggcctttggcatcaattaagagatactggtcgtcaatcaattcttcatacccattagcatgtgcttgtatctctgtttcaaaacggaagagtttgtcgtacacatgctcatacatctcatcgtgtggaatttcagatggttctacgtgaatatccacatcaaaaactccatgtttgagtgttaggagttgctcaacctgctcagtcacttcatgactttcataaacggataagtctggattcatttctaaaacaacatcaaggtagatattggctccataagtccgaccacgttgtgatttgacagaaacgatttttgggagtttgagaatatcttcctcgtactttttcaataagttttcatcaaatccatcagatagggtaaagaagctttccataaaaatatcgtaggctgtttttaggataaagaaggtaatgatgatggctgcaattttatcgacaatagggaagttgaaagccgcagcaaagatcgcgatagaagttcctatggaagtgactgcatcggatagattatccttggcagctgcttctaaggccttggaacgtactttttttgccaagcggttattatataaataaacagctaacataactagtgcagaaaaaattccgacaatggcccccataatgtctacttcgatagaagaattgctgattagtttttggagggtatcatagagtacttggaaaccaacgacaaacatgatgaaggatgtaatcaagcttgccaagtcttccattttccagtgtccaaatttatgatcggtatcagctggtttctgtgccatttttagtccaacaagtacagcgatattaccgataatatcagaaatattattgaaggcatctgctcgtaaggcatccgaatgaaagagctgtcctgcaacgagtttgatacctgataagacaatataggcaccgatagatagcaaggcaccacgttcagcaagttttagattggttacgttttggttcatagcatctcctttgataagttttcattttaacaaaaaggccccttattttcaaggggttaggctgcttttttgcctgttcgaagaaccttataaaggtgtaataatattgttccgctggccataccgatgggaatgactaaggctaaagttaagacggtagtgatattggttagggcttgagcgtggtccccagaaacgaaataagtcgtggtcatgtaggctcgatagcctggaacaagtggtgcaagtatagccaatgaaaagatgacggagggtgtttttaaccaaatactcatgatttgactgacacaggatccgataattgctgcgaaaaaggtagcaatcagtacattagttggtcctaataatgaaagatagatgagccaaacaagcatgcctaggagtccaccagggaccagcatttttctttgaacattgagaacaattaagaaggctgcgatagcgatataagaggcgagtgcctgtaataagaagtgaactggtgtcatagattacctcacaagcataaaggccacagttgtacctgcaccgagcgataagataataagcgcagtttggaaaaatttggtcatccctgtattgatatgattggtcatgaggtctcttacggcatttgtaaaagcaatccctggtacaaaaggcatgactgcccctgcattaatcaggttaggattaatggggagagtagtggttgcgcttaataaataagaggtgagtgagaagacaaaggcgccaacgaaggtggtgacaaaatcaattccaatatagcgctcgacaattagggagatagggaaagctaaagctgttgcgaggacagcacctgctgcatctaaaagagaacctccgaacatgatggtaaaaaatggtgcggctactacggcagctaaggttatttggatattgttataaggtggcttttgttgtttgattgcatttaattggctccatgcttcttctaggctgatttcttcattggctagggaacgggagatttggttgacgtcacaaactttctgcatgtcgtaatttgaattgacaatgcgtttcatacgcgaaatattcgtatggtcgatggagaaaaagatagcagcagggatggcaaggacattggcctgttcaattccttgtgaatgtgcaatccgaatcatggtatcttcaactcggtgaatttctgcaccgctttgtgccaaaatggcaccagcgagcatgagcacgtctatgaccaagtttagtctaggagtgttttccataagtaagtcccatccctctgctagttatttccttaattataacaaaatataggtgtaggcaacatatttttttaatagataggcaaaatagttgaaaattgttcggattgtagtataattgactcatcaatgattgattaatcaatcaaaagaggtagataatgcaagaaatggaagatttgttatacagattgaaagtgacagatgagacgatttccaatctttttgaaaagcagttgggaatcagtttgacacgctattcaatattgcaaacattactaaaagatgcacccctgcatcagttggctttgcaggagcggcttcagatagaccgcgcagcggttacgcgtcatctcaaattgttggaggagagtggctatatcattcgcaagcgaaatcctgacaatcagagagaagtacttgtctggccaactgagcaggctagagaagcgctaatcacgaatccttctgcccaccaccaagctatcaaagcttcgatgaatcagattctaactgttgaggagagcgagcaattcctagccactcttgataaactattgattggcttgcaaaatctacctatataattttttgagaggagacattatgtctatttttaccactattctagctagtatcgtagctattgagcacctatatatcatgtatttggaaacctttgcgacccattcagactctactagtcgcgtattcaatatggagaaggaagaattacaacgtaagtctgtgactgcattgttcaagaatcaaggaatttataatggcttgttggcggtcttcttgttctacggtatttttactggtaatttagaaattacaagcatttttgttctatgtgttattgctgcagcagcttatggtgctattacagcaagtccaaaaattatcttaacccaaggtggaccagctatcttggcattgatctctattttgttgtttaaataaatagaaaagccttccgtgaggagggctttttagcgattaccgaatgctcaattcaccatctagtgtagagatgttgaggtaattagtggattggggattggaataggttggaaggtcaattcccagattattttgactggcatctatatggatgtcagtttttgttttggaatgaagagaaatgtcgattgaaccaccgtaattactgatactatgtcttccttctagttttaggttttcagctttaaaatccccatcctcaatcgttaagctactgccgacagtatcggaaatgtctttcggacttattaatgtggaatgattgattgctacttctccattgaggtgtgacaaatgagcaaagctgagttgactgttttcaatcaacatgtcaccattttcaacaaagagttggaaatcttgaatagtcactttatccagatagacatctccttgaatgctccctgagagtgtttcgattgtgctatttttagggacctgtaagacaggttggtagtaggcaacattctggtcattgacaagatttaagataggttcgagtaaaccatcataagtaacgatgccttgataggcactagaaatggttaattttccatcttgaacttggtggctgaggaggtcaatgcctttgtgctgatttcggtaatagtggaggtgaaattgtttgtcaggcgagggcataatggacagtttttcattgacctctatagaacgaatatccgtaaagcttgccgtttggggctgaaaatagttttctgcaacagttttcatatttgtccaaccgccagccaggtagccaatgagactgagaattgttccaagagtgaacaggctcagactgattttcgtaaatggtttaagctgtttcataatagcctcctttgcgaatctttctttgtatccaatgtaaaacaagcaagaaggttttgcttccaaggtctagagtgaatttactacccaatagagtgagggccaagcagatgagggccaggcctgtgaagaggagggaggtagaccatgatagtgtgaagaggtcaaaggcgaggagtagctgggcgattgctagactgaggaggacaatccagagtgagataaggagcagaaagaggctaaagatgattaggagaagggtgatgaagagggcgaccaaggtgattgctagggggacgccgattggggcggcaaggatagagaggatggtcagccagaccatattgcgggtatttggcttatcctcagtcttctctttatcatagagattggctaggatttcatgggcggcttcttttggactgcctagctcttgaatagcttgctcatcgttttccttttcgtcaaaatattcattgaaatagtccaaggtatcttgaaaatcttcttttggtaggtttttgagatatttttcgagtttctgtaaatattccttgcgattcatggaaacctcctttatcccacactaagctggcagtcttgacaatgaataactagctgagcagggctattttcttgcttgtagctgagatgagtgatgtcaccctctttcatcattgtaaacgccttatcctttggaagtttaaggctagaatcttcctcccagatgtctaaactgatgtccgtacttggtttataggttaagacagaatcttcagcctggcagttaaggctcttttcaataacaaaatccttcaacttccagacacagtcttctaatgttatccttgcatctgaaaggctcatgcttgagagagtgataacagcatcgctggcttccaattttaactcgctcatctgtccatctgagatagttagtgtagagtcttctaaccgtagagcagagcttgggcagctcactttcgtcatgctgatactgctatcttttgcattgatgactagctgttcgctcgcttgcacagccgccatcgtcagactactatctgtcgttttcagattgagactagtaaggggcagtagttttttagggattttgagaatagcagagctggtttgattgtttgagaagtagaggtgattaggggtaggcttgcttgttaggtacaaactatcctgaaccagttgatagtcaaaagcctggtagctaccatcttctgaaacaggattgtgcaataagacagcttctccgttataactttgaacgctaagagcctgatcttcgagcgaaatctgtagatttgaaaactcaggtaattcttcaatcttcgccgtcaatttaattctttccctagcttgataggctgaatgtttaaaattgttgaaaaaattctcccagtcaaattgaaaatcaaaatcaaagttgaaatcaaatggtttagatgaatgtggacttgcttggtcttgctcggtgattagggcatcttcaggtagattggcaatgatttcctttgctgcttcatcaggtgttcctagctctataatagcttcctcgtcgttatccttttcgtcaaaatattcattgaagtagtctaaagcctcctgtctggcacttggatgaagttgaaataatgcttgttccagttggttcaaataatctgcgcgtgtcattttcgtaagctcccttctataattccgtcaatatggtctttgtagctattccattcaccttgcaggaaggggatgtgctcacgtccagcaggtgtgatggtgtagtattttctctttctcccttgaaattcttgggtataggtggtgacgtagcccgccttttccaattttttcaaaatagggtagagtgtggattcctttatatcagcaactatcttgatggtttgactgatttcatagccgtaggaatcctgcttttccacgatggctaagaccagaaattctatcaagatagaggatacggggtagtacataaactcacctctttatctttatgtaattattttatatataaattatatacctattgtttagcaaaatcaagcgattatataaaatttttatatatcatcaaaattcttttctatatgctatactagtttcatgaatgaacttgaattattagcccgtgctctcggttttatctttgttatcggtttaggttatacattaaaagtcaaagggattgttcgaagggaagatgcaagaatcttttctagcttagtgatgaatgttacgctaccagcttctctccttgtagcttcagcgacaacccaagtatctatagatttataccttcccttcatattagggattctttgtaatctttttttggatatggtaggatactgggaagcaaagaagtctggtcaacagacttccgtcggtcttatgcagttatcaggctataatattggaacctttacactcccatttgtgcaagctttttttccgctatctagtctactaagtgtcatcgtatttgatgcggggaatgcaatcatggttctaggtgggaattacagtatcgcagctggtgtggatgaagagcaggaaagaatgaccgttgcaacttttataaagaatctttcacgctcagttccactagtagtctatctagttagcctatcgttagcagtctgctctatcaaacttccacgcgaacttatctctgcgctgacgatagccagtaacgccaatccttttttagccatgctcatgttgggaatcttgcttgatttaaaattgaattggcaagaaattagtcgattggcctatcttctctctttgaggctgggtgcgaatattctaatagcaggagtcatttattttcttctacctattgataaaacgatgaaaatcatgttgctggtctgtctagtttctccgatttcagtcatgtccccaatttatgcattaaagttaggtagtcgctcagctgaacctgccaacgttaactccttatctattttggtcagcctagtcatgatggttcttcttatttttctattcgtttaaaaaagcctccgcgtgtgcgggggcttgattgtatattaatcaataaagaattcttgtggaccttggtaacgacttccatcattaaaggcgatgtagaggttaaagataggtgtaagaagaacatagaagatagcttgtacagctgataaaccgaagctacgaccaaaattgtaaacgagatagatgccatataatggtcctgctagtggaattagtaagaatagaatgaaccatcttttttcatagccgaaggtgatgcattgttggatatagagattgtagattggaatcaatgatttccaaccagcgtagcctgcttttttgaagaggatgtagttggaaatagcaacaagaatataccaaataaatgaaaatagtagtgttgtaccccaaatgccaatgagaattccctgtgctaatgtttcttctgtcataataaaactccatttcttttttatagttctattatactagtattagttcaataacacaacataaaatggcatttttttaaaattttttcagaaaaaaacgactttctattgaaagccgtttgaaattttatttgtaagcgacgattccaaggatgacatcgacggctttttccatggtttctaagctgacgaactcgaagcgaccgtgcatgttttcgccacctgcgaagatatttggtgttggaatgcccatgaaggaaatcttagagccgtctgttcctccgcgaacaggctcaatcagtggcttgatgcctagattttccataacgtccttagcaatgttaattggagtcatatctttttcgatgattttcttcatgttgtagtactggtcatgtaggttgacaatgacgcgtggagtgtcaaagttggcattcatcttttcagcgatgtccagcatgagttgcttgcgggcttggaaatcttcttcctcaaagtcgcggatgatataggtggtagaagcagtatcaacgctgccctccatgttcatcaagtggaagaaaccttcatatccttcggttttttcagggcggtctgtttctggaagggcattgtggaaatcaatagccatttggaaggcattgatcatctggtccttagcagatcctgggtggacattgcgtcctaggaaatcaatctttgcacctgctgctgagaaggtttcgtactggagttcgcccagcggtccaccgtccatagtgtaggcaaagtccacatcgaagtctttcacatcaaacttgtctgctccgacaccgatttcttcgtcaggaccaaagccgacacggatttcgcagtgtttgatgtcggggttttggattaggaattcaatagctgtcatgatttctgcaattcctgatttgtcatcagagcctagcaaggtagtaccgtctgtggtaatcaggatttgaccgtggtagttggcaagttgtgggaagtcttttggatgcaattcatagccagaagttcccaaggcaattgggttaccgtcgtagttttcgataatctgaggattcacaccttctgcgttgaaatcagccgtatccatgtgggcgatgaagccaatcttgcgggtcaaacttgggtcgttggcaggcagtgttcccactgcaaaaccgtttggtaggtagtggacattctgcaaaccaatccgttccatttcaggcagaaggatattctgtgcaaactcgacttggttttgggtagaaggagtggttgtcgaattttcatctgagcgagtattttctttgacatagaccaagaaacggtctaagagtgttgggtatttcatattgtctccttatttgttcaaaatgtgtttttcaatggccttggcaacgccgttgttttcattggtgtctgtgatgtcctgggcgatagccttgacctgctcgttggcatttcccatggcaataccaagtccagcaaattcaatcatttccaggtcgttgttggcatctcccatagccatgatttcttctgggaggataccgaggcggtctgccaatttttttaaaccagaggccttgctggcaccgtttggtaaaatttccaagagatagtcctgtgaacgaacggtggaatagcgtttgctgagtacaggattgtgttgattttcaaaggcatcaatatgcactttttcaccgacaaacatggcttcaaagaagcgatactgacctgactgggcttcttttaaatcaattggttgaggagtcattcctaccaaacctgcgtctaaattaacgcgtgcattggctttttctgcaagaacgaagtagtcttcctcatcaaaaagagagatttgcacatcagcattttcaataaaagtggaaagataatcaatatcagagatagatagttcttcccagtcaatcaggctccaatcctttgtcgaatgggttgaacagccgttattgacaatgataaattcttcctcggtgtcaaagccgagctgctctacgaaaggtttaacaccagccaagggccgaccagtacaaagaacaatcttgaagcccgcttcaacagcctgatgaatggcatcaatctgtggctgcatcagctcttttttctcgtttaaaagggttccgtccatatcaagagcgattagttttatcatataaacctccttgttttcaatacatctagtatagcataaaatgagaaaggaatgattgaaatactaaactctgttctatatgttaaaataaattaggtgacgaatgaaatatagaagtgtttcaaaaatgacaatgtccattatgtggcaggaaagtctaacattgctaggggatacaaaacatggagtatgagccagataaacaaaggtaaggacagtctatgaaagatgttataaaaaataattcagatttcaagataccgtttttcgatcctctggaatgaatagcattcatgcttaaagaatagagacaatggaaatatcggttatagaccggtgttttttggtataattaatagaaggatagaataggagcatgatatgaagattagtgtgaagaaagaggcggggcactacctgttcagcatttgctattctgtgtcggctagtttggcggagtcctgggatttgttggcgacagacagtggttttgcccactggtttccacagttgaacattgtaggaaatacgctggtttttgaaatggaaggatttcgtgaagttatggatttactggaataccgaaaaaatgagaaaattgcctacaggtgggattcagcaacagtttcatttgcactgtctcagctagaaaatcagaccttgattacttttgaagaacgaattccagaagattttggtaatgaatttgcgaatgctcaaaaagacatgacaggctggttggtgcaaaatgaatgtatcaaaaaattcttagaaggtcaggagccgcctgtgtgtcaacccttgcaggaaaagtggaggacttttctggagcttgaattagaaggtctgtgatctgaaaggaggctgttatgaaaaagtggtgggaacaactgaaagaagaatattatgaaacacggtttgattctaatgaagattggatggaatggtttatcaaacggaagatgacctggggctggagatggccgactgccataacgatttttgtcctttgggctctatcacttccagatgctagaaatgcggttcgtttcttttattttttattggcgctgggagtagctacggttttacataaattaatatcttatttgaaaagaagaaagtgagagtatatgcatcaaattacttgcccccattgtgggacggcctttcaggtcaatgaaacagaatatagtcagcttttagcccaggtgcgtggtgcggagtttgataaggaaatctacgaccgtttggagcgggaacgggaattattaagccagaaggctgaaaatgatttgcaggctagattgagtgataaggataaggagattctggaactgaccgcaaaacttgataaatttgctagtcagacggaactggaaatcagctctgctatttcccaaaaagaccaagaaatccaagagcttaaggctcagttggggcaaatcggtctcgccaaggacttggagttgcagcaggcggtagctcaggtggaaaaagagagggatgcggcacaaaatgctttggttttgcaggaacaaaagcaagagttagccctggcgaccactcgtcaggagtacgaagtacggctcaaggcggcggatgagcaggtggaattttacaaaaatttcaaggctcagcagtctactaaggcaattggagagagcttggagcaatttgctgaggcggagtttaacaaggttcgttcctatgcttttccacgtgccaaatttgctaaggacaacgaagtatcagcgtccggttcaaaaggagatttcatcttccgtgattttgacgagtcgggcttggaatttatttccatcatgttcgaaatgaaaaacgaggcagatacgaccaagaccaagcataaaaacgctgatttctttaaggagttggataaggaccgtcgggagaaaaaatgcgaatatgctgtattagtcagcatgctagaggcggacaatgactattacaatatagggattgtggatgttagtcatgaatatgagaagatgtatgttattcgaccacagttctttatccaattaatcggaattttacgaaatgctgcgctcaatagtctgcaatatcagcaggagttagccttggttaaggagcagaatattgatattactcattttgaagaagatttggaaattttcaagaatgcttttgccaaaaactatcaatcggccagcaacaatttccaaaaagctattgatgaaatcgacaaggcaatcaagcgaatggaggctgtcaaagcagccctgaccaccagcgaaaaccagcttcgcctagctaataataaactagacgatgtctccgtcaaaaaactaacccgcaataacccaaccatgaaagccaagtttgaggcgttgagggaggattgagatgattgttccgttacaatttgagcatatacttcaacttgatgaggccttccagaagcaaggttggccctcccgcaaagagattttaaccaactatttaagggaacaagaaaagggagaacgtatcgtcctagttgctgaagaaacgggggtttgtaaaggttatatcaccttgattaagcaagtgaaggagggacagttttaccaatctggaatacctgaaattgctgatttcaatgtttttgaagactttcaaaatcaggggataggttggcaattatagtcaactgaaacaagagcaggacgaaagtgcctcaagaaaagtatcgcaatttggcaatactcttctgaggtgttttttgatgtgagcccatattttctcaatgggattatattccggtgagtaaggaggaagtggtaaaagtctatgtccctgctcctcgcataaatcttttagcttactcatcctatgaaactttgcattgtccataatgataacagatggtttacctaaagtgggtagtaagaatgttttgaaccaagcttcgaaaaagccactcgtcatagtatctttgtatgtcatcggggctataagcgcaccatttatgagacctgctactaaagatatccgctggtatcttcttccagagaccttaccttttatcaactgacctttcaaagagcgaccatattttcgatgaaaatatgtctcaaaccctgtctcgtcaatataaacaggagtcaagtggcttaagttattcaattctttaaggaacagttctactttttcagggtcttgttcatagtaggtacagctcttttttttcgagtatatcccatagctttgagggggtaatgaatagctgttggatgacagtcaaattcagaagctatttcagtcaaataagcatctggatgagtttcaagataattctttaatttatctctatccacttttcttggcttggttcctttaacttggtgatgaagctcgccggttttctcttttaattttagccattgatagatagtgttacgtgaaacttggaaaatagctgatgcttcagtaatactgccggttttctcacagtatgcgagaacttttttacgaaaatctaatgaatatgccataaatacattatatcataaatgtactgtttttgtttcatttaactatattagatgctatctgccaacttgcctcagaatttacggatacagtaggtattggagttggtttgaatgcaaattatggaaaggctcaacggctctatgtaaaacatggtttcataccagacggaagcggtgtctggtaccgagggtgctctttgccagtaggtgccaaagcctataacgatgatgaattggccttgtattttacaaaaaaattatagaggaaaagtaaaatgaacaccatcgacctaaatctgcctgttgcagagattatcaaccagcacccagaagtcaaggacattctggtagagcttggtttcaagcccttggcaaatccagctatgctgaacacagttggtaaggtaaccagtctgaagacaggatctaagatgaccaagattccactagaccgtattcaacaggtcttggaatgcaacggctacgaggtaataggaggagaagcatgaccgaaaaacgtgttgacattctgaagaatattctcttggacctgcacaatggggccagtccagagtctgttcaggaccagtttaatcagcatttcacgggagtttctgccttggaaatctccatgatggagcatgaactcatgtccagcgatacgggtatcacttttgaagatgtcatgagcctctgcaatatccacgccaacctcttcaaaggagccattgcggatgtggatgtggcggatatggaccgggaaggacaccctgtctatgtctttaagcaggaaaaccttgccctgcgggcagctctcttacgcatccgccgtatcattgaccagtatgagcagacagaggatgcagagctgaaagaccagctcctgcaaggtttgacacgccagtttggcctcctcggtcaatttgaaaaccactatacccgcaaggaaaaggtcttctttcccattatggagcggtacggttatgatgcaccgcccaaggtcatgtggggtgtggacgacgagattcgcgatctcttcaagacggcccgtaaggcacttgaaggaggtgacctagctgcgacacgtgctcactttgaaaacttcgccaaggagttcgaggagatgattttcaaggaagaagccatacttctcatgattttgctggagattttcacccaggacgactggctccaagtggcagtagacagtgacgcctacggctacgccattgtcaagccgacagccaagtgggtacctcatcgggaggctttttgggaaatagcagagcaggaagtaaatgctgtttctctgcagccagcaggaccaaatcagcagattatcgacacgccagaaggccagtttaccattgccttcacacccaaggaaaagtcagaaactgttcaggacagaactagtccgcagaccttcggcaatggttatttatctgttgagcaagcgaatcttatcctcaatcatttaccgctggaattaacctttgtcaacaaggatgacattttccaatattacaatgacagccaccctgtcgaagacatgattttcaaacgaacaccaagccagattggacgccatgtggttcaagtccgagagcatgggcaagtttgtctatgtagtctataaggcggtgcgtgatgaccaaggagagtttcaaggcgttttggagtatgttcaggatattcaaccattttttgagattgatagcgattttcatcgggatatctagtttagtcatttttgaaaggaaagaacatgaaacaatttgaacgtacatacgagaatattgactttattctttttaaggcttattatattgaaggaaagagcgtagatgttgcggtcagtcttagggagcaggagtatatgattgaatatataggtgcagataatcgagttgagaattcagtagattacacttctattcgtatcagcaaggcaaaaaaatttagagaatttttgaaaggaaatcaagctgttggattggccgaccataaaaattggtgacgaaggctattatgatgccccattgatattttcttggggctatgatgaggaggctgaggaaagcattgatgaggcagttgcatatgaagcagcaccttctggaaccatgcgacgtattcataaggaactagagaatttgataggtacaacattcggtagctatcgtttctacgatgactgattgataccggaccgcccacaagagcggtcctttgtgttataatgagaacatgatttcaggaattattaatgtaaaaaaagaggcaggtatgacctcgcatgatgttgtttttaagctccgcaagattttgcaggagaagaagattggtcacggtgggaccttggatccagatgtgacaggtgttctgcccattgcagtcggcaaggccacgcgcatgattgagtacatgcaggaagagggcaagatttacgagggggagattaccattggttactctaccacgacagaagatgcatctggcgatcttgttgagcggacaccggttttgtacatagcagagcaggcagttgatgaggctatgaccagtttcgtaggcactattacccagattccgcctatgtactctgctgtcaaggtcaagggccgtaaactctacgaatacgcacgggcgggcgaagaagttgaacgtcctcaacgccaaattgagatttacagttttgaacggactagcccgattgaactagcagatgactgtgcacggtttaccttccgagttcgctgtggtaagggcacctatgtccgcaccctgtctgttgacctaggggctaagttgggctatgccagccatatgtccaagttggaacgaacaggatcagctggaatggacctagcggatgccttgactttagaagaaatttcttcgctggtagctgaaaatgatttttcattcctccaacctattgaacgtggtatcggggatttacctgttgtagaattgaaagaagagcaggtgcaagatgctacatttggtcgatttgtcgaattgaatgcagaagcagagcgcttagcaggctttcatgatggtcagttgattgctatttttgaaaaacgcgaccagctgtataaaccgagcaaggttttggtctaagaaatttctcaataactgtgataaaatagaaaacatgaacattagaacaattaaacattatagtgaattgaatcaagaggagccgacggttttagtactgggctactttgatgggattcatcttgggcacaaagctttacttgatcgagcaagaaaagtagcagatgagcaaggtttgacagtaactgttctgacctttccagagtcacctcgattggctttttctcgctttagcccagaacttttactgcatttgactagtcaagagcagcgctacctcttattgaaaaaatatggtgttgataatcttattttgactgattttactagtgaatttgctaataatactcctcagcagtttatggagcgctatattaaaggtctcaatgcccagattttggttgcaggtttcgactatcattttggaaattgcagagcagatgtcaaagatttgacagagttatttgatggtcaggtagaaattgtaagtgaagtgagcctgggcggagagaaagtttcgtcaactcgtattcgtcaggctatccagtcaggggatgtctctctagctaatcaacttttaggttatccatttatgacggagggaattgtggtgcatggagatgccagaggacgcaccatcggctatccgactgcaaatctggctccttttgaccgtgtccatttaccatctgagggagtctacgtcgctgatgtcgaagtagatggaaaacgctatcgagctatgacaagcgttgggaaaaatgtgacctttgatggaacggagatgcggatagaagcccatatttttgggtttcaccgctttatctacggagaaaaaataactattttttggcttgaaaaaattcgagatatggtcaaatttgatggaattgaaggattgatggagcagatgaaatctgatgagaaatttgccttgcaatgggggaaatatgcttaaacgattgattcgtcatcctttttatgagaaggctatgacctacatagctgtagtctatgtatttcttatcgtacttgaattaatggatgctagtattgccaattctagtgggtatcgggtactagacttgctcttatggtttatttttgtttgcgattattttgctcagctttattatgcggatgacatacttgaatatgtacagggacatatcttggaattaattgccattattccatttgattcattcttcagttttcttcgcttgggaagacttgcacgactcttcagattggtcaaagtaacgagaatatttgccctgtctaatcgattctgggatacaatcaacaagcttttgcataccaacagtttatccaaagtgttgatgttaaatatctcagcagtgctagtttcaagtgtcttattatcagtaattgaaggaaaatcattcttcgatgcactttggtggtccattgtaacgatgacaactgtagggtatggagatattgtcccccaagatacgatttctaaaattatagccatcctcttgatgttggttggtatttgtacttttggtatggttacctccacaataactcgttttttctctgaaacagagcgagaaacgaagttggatatcttgatggcaaaaattgatgaacaaaacgaaacattattacgcttagagaaaaaaatagaatctttaggaaaattaggtgaattacagggaagagattagatttactattgaaaactcttttaagttagagtataataataagaagaaaaatgtttttagaggggatggaagacatgattactttatttttgtcaccgagttgtaccagttgtcgtaaagctcgtgcttggctgacaagtcacgaagtcccttttattgagcacaatattatgactagccctctaactgctgaggaattaaagaacattttagcattgacagaaaatgggacagatgacttgatttctacccgttcaaaagtttttcagaaactagatattgatgttgatgagctttctgtgaagcagcttattgggttaatcgaaacctatccgagtctcttacggcgtccgattattttggatgagaagcggatgcagattggttttaacgaagatgaaattcgtgcatttcttccgcggaagtatcgcaaacaagaactaaaaaatgctacattgagagcagaaataggataagaaagataaaagatatgaacaaaaattattcatatccacttgatttttcgtggagcacagaggagatttcctccgtgctttcttttttgaatcaggtggaggcagcttatgaaaaaggagcagatgcggtagctatattagctagttataaaagcttcaaagatgttgttaaaagtaagggacaggaacgtcaaattgatcgtgactttgaagcagtttctggttattcaacctatcgagttgttaaggctgctcgagataaagggaaaggagttatttgttttggaaactaagtatcactttgcccaaacgattgtcctggaagctggaaattttctccgacagcatttacatgatgatcttcagattgaagaaaaaggtgactttacagacttggtaacacaccttgataaacaagtgcaagaaatgttgactcaacagattcaatctcgctatcaaggtgatgggattttaggcgaggaaggtggggacgtttcttctattcatgagggaaatgtttgggttattgatccaattgatggcaccacaaattttattgctcagaaaactgattttgccattatgattgcctattttgaaaatggagtaggaaagttcggtatcatctatgatgtcatgcgagacaaacttttccatggaggagattcattccctgttttttgcaatcaagaacgcttaaagaaaccagagctgcgccctcttcgccagagtttgataggaatcaatgcaaagttgtacgcaggcaatgcacatggagtggcagaattagcaaatcaaagtttaggtacaagatctgtaggaagtgctggaattggtttcgcccacgttctggaaggaagattatttgcctatgcttcttatctgtgtccatgggactacgcagcagccagtattattggttcctctttaggcttagtcatgttaagttttgagggtccgagtctggcctatgataagcgagagtttgtcatgctagtatcagaatcccatcttgaggaagtgaaggggtatatattctaatgcaattaccacaggattttatagataaatataatcatttgcttggtagtgaagcccaagcattttttgagagttttgaacaagacccaatctcaggatttcgcacaaatcctcttaaagaaagccaattggactttgagcaaccaatccctaatatgacttggtcatactatggtaaggtctcagggaaatctccagaacatgtaactggcttagtctactcacaagagccagctgcacaggttgtaggtcagattgcagcaccgaaaaaagggatgaaagtattggacttggcagcagcgccaggaggaaagtctactcacttgctttcatacttagaaaatacggggctcttggttagtaatgaaatttctaacaaacgagcaaggatattggctgaaaatattgagcgtttcggagcgaggaatgttgttgtaacaaatgaatcagcagaccgcttggaaaaggtctttccaggatatttcgatatgattgtcctagacgctccctgttcaggtgaagggatgtttcgaaaataccccgatgcgattcaatattggtccaaacattatccagcacaatgtgcaagcttacagcgtgaaattttagaatcggccttgaacatgttggctccagatggtcaattgatttattctacttgcacttggtcaccagaggaaaatgaagaagtagtgacttggctcttagaacagtatgatttggaactaatagacattcctaaaatcaatggaatggtagaaggaatcggatatacagaagttgctcgtatgtatccccaccattttgcaggagaaggtcagttcgttgccaaatttagatttctaggggaagccagtcagaaaaaattaaaaccaggaaaatctaatttgaatagagaacaacaatctctctggaaagaatttgaacagaagcatttaagggttcaattggatggtttactgcaggtttttggcgacaatctctacctactgccacacggccttcctgatttgtcaaaagtaaagattgctcgaaatggtcttcacttggggacgtataagaaaaaaagatttgaaccaagttttgctttaggtctagcactccatagttcggaggttgaaaatcgagtggaaatcagcttagaagaattctcgtcctatactgcaggacataccatagctgtgtccaaggatttagctaatggctggtatcaggtagcagtccaggggaacggtcttagtttcgcaaaaattgtatctggaacgcttaaaaacggctttccaaaagggttgagattttaaaataaatcagcaaattttttttgcaacttgtctttttatatgatatagtggatgagtggaaatatcttgtaaattctatgtaaaatacagagttaattttaggagattccactgaaaaatgtaaaggaaaaaatgaaatgaaaaaaaagcagaagcttggaattgcagctttgtttcttttgagtagtatggctctttctggttgttcttcttggatcgatcgaggagagtctattacagccgtaggttcgacggcgcttcaaccacttgttgaggcagcggcagatgaatttggtagtgtcaatatcggtaaatccatcaacgttcaggggggagggtcaggtactggcttgtcacaagttcagtctggagctgttcagattggtaactctgacgtatttgctgaggaaaaagatggtattgatgcaagtaaacttgttgaccatcaagtagcagtagctggtttggccgttattgtaaatgagcaggtatcggttaaagatattactacagaagatctgcgtaaaatttttacaggtgagattaccaactggaaagagctgggcggtaaggatttggaaatttcaatcattaaccgtgcagctagttcaggttcacgtgcgacctttgatagtgttatcatggatggacaaaccgcaactcagagtcaagaacaagattctaacggtatggtaaaatctattgttgctcagacaccaggtgcaatttcctacctatcatttgcttatctagatgattccgttaaaacaattaagttaaacggttttgaaccaactgctgaaaatgtagcaacaaatgattggccaatttggtcctatgagcatatgtatacgatgggaaaagcgactgatttgacagaagaatttttagattacatgatgtcagatgaagttcaaaatggtatcgttgaaagtatgggatacatttctatcaacgatatgaaagttgtgaaaagtgctgatggcacggtgactgagaaggagtaagcatgaaaaacgaacaactagcaaaagagttatcgtctccatctaaaaattctcgattagagaagtttggtaaggtaattacattcctttgtctatcattgattgtctttattgttgcaatgattttgattttcgttgcacagcgtggattatcgactttctttgttgacggtgtgagcatcactgatttcttatttggaagcaagtgggaaccaagctcgaaaatatttggtgccctgccaatgatttcaggttctttcattgttacgattctgtcagctgttgttgcgacccctatcgcaatcggtgcagcggtcttcatgacagaaatatcaccaaaacgtggtgcaaaaatcttacaacctgttatcgaacttttggttggtattccatcggttgtatacggtttcattggtttgcaagtagttgtgccatttgtacgttcaatcttcggtggaacaggtttcggtatcttgtcgggtgtatttgtacttttcgttatgattttgccaacagtaacctttatgacggttgacagtttacgtgcagtacctcgtcactaccgcgaagcaagtttggctatgggagccactcgttggcagacgatttggcgtgttattttgaacgcggctaagccaggtatttttacggccgttatctttggtatggcgcgtgcctttggtgaagccttggctattcagatggtagtggggaactctgcggttatcccgacttccttgacaacgccagcagcgactttgacttctgttttgacaatgggtatcggtaatacagttatgggaactgttcagaacaacgtcctatggtccttggccctagtcttgctcttgatgagccttatctttaacatgattatgaaatttattacgagagagggtaagaaaaactatgcacgctaaaaaatttgataaattggcgactggtattctttactcaatcgctggtgtgattgtcgttatcttgacgtcactgattctttacatcttgctacgtggtctgccacatgtaagctgggattttttgacaagtaaatcttcgtcttacaaagctggtggtggtattggaattcagctctacaactcattcttcctattggttgtaacgctcttaatttctgttcccttgtcaaccggtgcaggtatttatttggctgaatatgctaaaaaaggtccattgactaactttatccgtacctgtattgagattttgtcatccctaccttccgttgtcgttggtttgtttggttacttgattttcgttgttcagtttgagtacggtttttctatcttatcaggtgccttggctcttacagtcttcaacttaccacagatgacacgtaacgtagaggacagccttcgtcacgttcaccatacacaacgtgaagcaggattggctcttggtctatcacgttgggaaactgttctccatgttgttattccagaagcacttccagggattgtaacaggtatcgtcttggcatctggtcgtatcttcggtgaggcagcagctcttatctacacggctggtcagtcagctccagctcttgactggtcaaactggaatccattgagtgttactagtccgatttctatcttccgtcaatcagaaacccttgcggttcatatctggaaggtaaacagcgaaggtacaattccagatgcaacccaagtttctgctggttcagcagcgattctcttggtcttcatcttgattttcaacctttctgcacgttatattggtaagaaacttcatgcgaaactgacttcagcagcctagaagtctgacttataaggagaaaaaatggcagattacaactggaatgaacgccatatcattacttttccagaggagaatatcgccctttcgacaaaagatgttcatgtttactatggtaaaaatgaagcaatcaagggcattgatatgcagttcgaaaaaaataaaattacagccttgattggaccatcagggtgtgggaaatcaacctatcttcgcagtcttaatcgtatgaatgatactattgatattgctaaggtaaccggtcaaattctttatgaaggaatcgacatcaatagaccagatatgaacgtttacgaaattcgtaagcatatcggaatggtattccaacgtcccaacccatttgcaaaatcgatttatcgcaacatcacattcgcacatgaacgtgcaggtgtgaaagataagcaggttttggatgagattgttgaaacttctctgaaacaagcagccctttgggatcaggtaaaagatgacttgcacaagtcagcctttaccttatcaggtggacagcaacagcgtttgtgtattgcacgagctatctctgtaaaaccacaaatcttgcttatggatgagcctgcatcagccttggatccaattgcgactatgcagttagaagaaactatgtttgaattgaagaaggactacaccattatcattgttacgcacaatatgcaacaagcagctcgtgcaagtgattacacagctttcttctatctgggtgacttgattgaatatgataagacagcaaatgtcttccagaatgcaaaactcaagtcaactagtgactacgtttcaggacattttggatagaaaggaaacaaatgacatcacctattttacaagtaaaagatttgtctgtttactataacaagaaaaaagccttgaataatgtgtcaatcgatttctatccaaatgaaattactgctttgattggaccctctggttctggtaagtcaaccctcttgcgttctattaaccgtatgggagatttaaacccagaggtaacattgacaggtgcgattgattacaacggaaagaacatatacagtcctcgtacggatactgttgatcttcgtaaggaaatcggtatggtattccaacaaccaaacccattcccgatgtctatctacgagaatgtcgtttatggtttacgtattaacggtatcaaggacaagcaggtcttggaagaagcagttgagcgttccttgattggtgcttctatttggaatgaagtgaaagatcgcttgcatgactcagcagttggactttcaggtggtcagcagcaacgtgtatgtgtggcccgtgtattggcaacaagccccaaaattattttgttggatgagccaacttcagcccttgacccgatctcagctggtaaaattgaggacacactttatggtctgaaagataagtatacaatggtgctagtaacacgttctatgcaacaggcatcacgtatttcagatcgaacaggtttcttccttgatggcgatttgatagaatacaatttgacaaaagaaatgttcttgaatcctgccaataaagaaacagaagactatattacaggtaagttcggctaaggcctataagaaaaagaaagaggttcatatgttaagagctcaatttgaagaggaattaggaaaacttcataaccaattttacgccatgggaaatgaagtattggctcagattaataatgctgttcgtgcctttacaattcatgatcgtgaattagcaaaagaagttattgaagcagataagaaaattaatgctttcgaagtgaaattagagaaaaaatcacttgaaatcattgctctccaacaacctgtctcaacagatcttcgtcgcgttatcacagtcttaaaagcaactagtgatttggagcgtatgggagaccatgcagtctcagttgctaaagcagctatccgtatgaagggagaagttcgcatcccagttgttgaagaagaaatcaagaaaatgggacgtgaagttcgtcaattagtagaagaaactttggaactctacttaggtgatgctgatatggagcgcgcttatgaagtagcagcacgtgatgaggttgtcaatgaattctattcaactattcaagaattgacaacggaagaaatcaagaagaatccagaatccttggttgctggtcgcgactattaccaagttttaacctacttggaacgtgtcggtgattatgctaaaaatatttgtgagtgggttgtttatctacgcacaggtgatattacagagttgtaattcagaagtccgagagggcttcttttctaccatttgtcaagttcatcaaggtatttgacgaaaaatattttgtgtctcgtcatccaaataaggaaattgttttattttggactaaagttacgtgtaaaaagtgcatacaaaaccaacaccttatgttgaaattttttgataaggtgttacaatgatagagcataaacagttttaccgattttgggttgaagcgtaatcgtaaaatttgttatgcataatgaggtaatacattgtccgaatgagacgatgtatggaggcaatcgtgtgcagcttcgttgaagtcgtttgcgattgtctttttcgtttcttataaaagtctgcgatatggcaaggattggtatgattggctgaagcgatattgtggatacacttgaacagaatctttctagcgtagggattaccacgcttggtaatgtgttccttagcgaggaagttaccagattcatagtgtctcaggtcaataccgataaaggcattgatttgattggcagactgaaaacggcgaatatctcccagttcaccaataatacttgttgcagtagtctcagctattccaggaatagagagcagaatgtcatattcaggtaatggctgagctagttccaccatttcgtctaagactgcctgtctctgttcagaaagtctaagcaattcttttgtatagtaacggacctcttccagtattggagaggttttcttgacggcacaataagattgattagctagtgctataagcttctcggctaagtaagccacacgcttgtcagaaatccgttttgaagtggacagacggatgctctttgagagttcatcattgcttaactcaagtacgcagtccttacaaggaaaagctataactaagttccagtattgttcgccagatggtgtcgataagatattttccaattcagggaaagtgacctgtaagaccttgtgcaggcggtttttagctcgaacaatatcctcggtcagattctgatagaaacggctgagatcccgcaagttttggtagacttcttcttggacataagtgggtttacgattcagcacaaattgagattgagccagtttttcagcgtcaatttgatctgttttccgcacacgcaagctatccagttgcttcttagcttctaagggattaagccgtgtataagcatagccattatcatctagaaaagtttggagacggcgagaatagacacctgttgcttcaaagatgatttctggcttatggacggttctcaaatcgccaagtagccgagcaaagccgatggcgtcattggatatggtatagccatgaactttctcaccattgactagaatggccacttctgaacttgccttactcacatcaatcccaaaaactactcgcatgatattacctctttgtcttgaatgattccttgttttagcgatgtcattttcaatactcgacgtctggcgtcccacatactttgataacattctttctaaaacaggtgtcttgccagtttttgttgcgacgtctagcgtcaaaagcaccctcgacttaacaagacacctctactttatcataaagaaaaagtagtgagtactttctcccgtcggagatttcctcactactaatcttagtatgtttttgtgtaatggacttttataaaaaatgctgaatttctttagcttgttttaagttttcaatactatactattatcatcaggtgaagaggagttatttaataggtctcattctgataatattctattgaaaaggggaatttcatgtcatttattaatcaatttaagtcacagtcaaaaacagtactagctactgttgctatttcagttgctatcttgggctttgcagggggaatgagtatttctaaaagctcagcaggagtttcaacacaaagtcaggtaactttggcgcaaaatggttccgtagctaagagtggacaagtagctacccaaggcatgctaccaggtcagggaggagctacacaagatatatcaccgggacaaggtataactcctcctgatgcgacaagtggagcaactcagtcaaactcgagtacttcttctgatgaagtgaatgctttaaaaaagaggaatcaagaaattaaagctcaaatttcaggagatagtagttcttctaatcaataaatattgagatttcgatttttacttattccatgatataatgaactcgtatcaataaatagttagataaagactaccttatcattcatttttcagatggtcatagtagtactttatctaaccatttctcttaaagaccgtgacctgtcccaggtctttggtttgtttattaaaccgaaacgtaaggaagtgtatgatgattaaaatattgttagtggaagatgatttaagtctatcaaattctgttttcgatttcttagatgattttgcggatgttatgcaggtttttgatggtgaagagggcgtttatgaggcggaaacaggcgtttatgatttgattcttttggatttaatgttacctgaaaaagacggctttcaagtcttgaaagagttacgtgaaaagggggttacgacaccagttctgattacaacagccaaggaaagtctagaggataaaggccatggttttgaattgggggctgatgactatttgacaaaaccgttttatttagaagaattgaagatgcgaattcaagctctattaaaacgagcgggtaagtttaatgaaaacacactaacctttggagatgtgacagttgacctatctacaaatatgacgatggtaaatggcgaagaagttgaactgttaggaaaagaatttgatctactagtttatttcttgcaaaatcaaaatgttattttgccaaaaacacaaatttttgaccgtatttggggctttgatagtgatactacaatttcagtagtagaggtatatgtttctaaaattaggaaaaagttgaaaggaacgacttttggggaaaatcttcaaaccctgcgtagtgtcggatacattctaaaaaatgcctaagcgatttaaaaaattaatgtacacggataaattttctttctttatccgttattttgcagtatttactctgatttttggtttaatgacagccatcatttttcaattaatgcgttcaactatgtaccaaaattcagataacaccttgaaacgcattaagaaagaaccagcgctggctgttggttttgcaatcgcaagaacctatgagcccaattctgtatttatccttcaagatagtccaactggtgaagaaactacgagctctagttcagatagcatgcctgttcctaaaaatcaaaaaaatactagagctggagatcagctgagattaggtgccaatactcatgttttactctatagtaaaagtggagagatgattaatccagatacttttactggtttggccgacctatcattagacaaggaaaaattgggtgaaattaaggaaactacggttgaatcaagttttggtatgtctgaagattatcgctatataacgattgggctggctacagatgaactaggttattattcgtcctatgatataaaatatgcgacaattttggtgaatgtcagccaaattaaatcttccattgagagctatgaatcgacagttgctattgttatggtatcagcttggttgatttctatactagcaagtatttacctatcgaatcttagcatgcgtccaatcctaattagttatcaaaaacaaaaagacttcgttgaaaatgctagtcatgagttacgcacaccgttggcagttcttcaaaatcgcctggaaagtctatttcgtcatcccgagacaactattttggaaagtagtgaaagcatcggatctagtttagaagaagttcgaaatatgcgactattaacaacgaacttgctcaatttggctcgtcgtgatgatggcttaaaagtcgatatgatcgatgtccaacccaactattttgatgaaatctttgctaattaccttatgattgccgaagaaaatggaaaaactctaacagttaataatttgattcatcagccaattcgaacagacaaggttttgattaaacagttgctcaccattttgtttgacaacgctatgaagtataccgatgatgatgggacaattcaaatagcagctaatatcaaggacaaactagtttgttttacagttattgacaatggtttgggaatcagcgatgtcgataaaaagaaaatctttgatcgcttttaccgagttgacaaggctagaacacgtcaaaaaggtggatttggtttaggtttatctttagctcaacaaattattaagaatctagatggtgagatttctgtgagagataaccaaccgaaaggaactatttttgaggtacgtttacccaaataactaaccattcatcaagattagaggttgagtaaaaaatccagcctttcttctcaaagttcgctctatttccaatttccaacttccaactgtctcccaggtagttttgtagcgaactctgttcgctctatctccagcctccaaaggtttggggaactgtttcagctggtcacctaaaaataagaaagtgaccatagaaaatcgaacctaaatgtttggaagtgaggggaattctttttcgatctattgaattctttccactccctttttgttttgtgtagttcgtcagaagtctcctgattatgttatacttaaacaagaatgtaggtaaatatgaggaaagtttctcgtggcgttttaaccatattattatcagcgacagtcctttctgcttgttcaggaggaggacaagagctgagtgaacgtttggaagcagctaaaattgaattttctaaagaaaaaaagcaactagaagcagaattaacagcattaaaagaagaggttcaaggaaatttctactaccaacaattggatactgataaggaacgtcgtgtctatctccaatttgttaatgggctcagcaagcggatgcaagtgatcgatattgattctgttaatgatgaaatatattcgcgcgtctatttttctgtcgctcatgattatccagaattttactggctaactgatgaagcagcaatgagtggcggagttgatatattggatttagaagagccagtgtatccgactgatttatctccgacacgaaataaaatagaagaggaagtgaataagatacttgctcaggcaccgacagggtcggactatgagaaggttaaatatttttacgaggtgattataaagcaaacggattacgaccttgaagccctacaaaccaactctgtcacgtggagaagccaaggtgctattagataagaaatccgtttgtgctggctatagtcgcaccttccaatatctatgtaaaaaagcaggcattgattgtatctatgtcacagggattgcaaaaaatgggcaaaacggtgagtttgggcatgcttggaatctagtcaagataaatggacaatactatggtgtcgatacgacttggggagatccagtttttgatcaagctataagtggagaagcgcatacagatatttcatacgattatctatgtgtccctgatgaaatattagagagaagtagaattgctgataccgacctactcgactactggggagaagaacaatattacgaacctagagcattgacctatccaaagtgtacagataattcattgaattactatgttcaaaagggagtttatttcacaagctttgatgaagctgcagttttacagtccatcactgaccagcggctacaaggtacgaataaagtagtcttgcaattcggaacagcagaagcaatgcaacaaatgattacattggcctctactgaaaataatgctatttttcaggctttgggcgatgtaagagagtatcagtactattataatgaccaaacctatacatttgaactggcagattggttttaaggaattagtttgaatctccaggagcgtgttcttccctaataataaaaaatagggagtgggaaagacatccatgatggctccgcctcacccacagaataatgaaaacgaacataaagccctcactaggtgtataatcttagtgagggctttacggttgacgagttaatgatgttactcatcgagggaaaactgatccactttgtcccgcctccttatgatggaaaaaataaaaaaaaaaggaaacccaaaggtttcttttttaattatgtgacttttagtccgtcacgctccgtaaggtgcgtgacaaataaaccacccgctatgcgggtgcgcgacgaaggttacaccaaaaaaactccaaacgcgatacaataaaggtgttcaagcctattgtaaagcgaaaggagaaaaatatggcgcaaaaggcacatagtttatcacatacaaagtggctgtgtaaataccacattgtcttcacacctaagtatagacgaaaaatcatctataatcaatatcgaagtagtttgggagaaatattccgacgtttgtgtacttataaaggcgtagaaattatcgaaggacatctgatgccggatcatgttcatatgttagtcagtattcctccgcgattaagtgtatcaagctttataggatatttaaaaggtaagagtgctctaatgatgtttgataaacacgccaatctcaaatacaaatttggtaatcgtcatttctgggcagagggatattatgtaagtacggttggactaaatgaagccacaattaagaaatatatacaagaacaggaaaaacatgatatagcacttgataagttgagtgtaaaagagtatgaagatccctttagggataatggcaagtagtacgaatgcctctttaagaggctagtgacgagtcaaaagcagtgaggcttgaacaaagtgaaagccagcgtctttaggcgctggctggtgatgtgggcttatagcccttgttcaaaccacccgtttgacgggtggtcatgattaagcaagttttgatgcaagacgtgctttatcgcggcttgctttgtttttgtgaatcaaacctttagtttctgctttatcgattgctgaactagcagcacggaaaagctcttcagatgggttagcttcaaatgctttgattgcagtacgcatagctgatttttgtgctgagtttttctcgttttgtttaacgttcaattcagcgcgtttgatagctgacttaatgtttgccaatggtttcacctccaccctttcttgtactaactacaccattatatctgaaaagagtatttttgacaagtgaaatttatttttttagataaattttatcaatctcatggttttcggccttatgaagaataatatcagcacggtttctggttggttcaatgaatttttctaagttagctagattaatgtttttccaagtattctgggcaatagatagaatttcagggtacgtcatctgggtaaaacgatggtaatagttgttagggtcattttttgccaatgtcaataatttttggaatcgctccaagtaccaggtttcaatatgctccacatcagcgtcaacgtatatagacaggtcaaaatagtcactgacatagaggcgctggttttgtggattttgaaatacattgattccttcaacaatcaagaaatctggagacttaatttcctgagttttgttggggataatatcatagatttcatgtgaatagacagggatttggcagtcgtagccgttttttatcttatcaaggaaatcaatcaatttctccatgtcataggactcaggaaacccctttttatttaacagttgccgttcttctaaaaccgcatttggctggagaaaaccatctgttgttactaattcaaccttggcgtatttaaatgtccgagcgataagaatttgcagcaatctactagttgttgatttgccgacagcaacacttccagaaacgccaatgataaatggttgtggcttgatagtcttctgtagaaataaactcttcgtaaaatttaggtctttgcgtgctttccgatagatatggataagattaaccaaaggaagatagatgtcagaaacctcatgtaattggatgcggtcgttaaaacttttaatagaatttagttcgctttgactaagtggaatggtagtcttacgatgtagttgttgccaagtggctcggtcaatttgttcaaaatttaaaaattcatttttcatacataattcttcctataggtaagcgtttcaatatcgatttcattttatcatatttttcatgtaagaaaaactcttgaaaacgtttttaggaaatgttataataagtacatgtccaatatgtattacgaaaaaaatcctacaatagcacatgatattcatgaaatccacgtaaacttactagacaccccaatgtctttcatgacagatgcaggtgtttttagcaagaagatggttgattatggtagtcaagtgcttttaaaaaacctttattttgaaaaaggggcatcagtgttggatgttggctgtggttatggaccaattggtttgacacttgctaaggtgtttagtaccaagacaacactgattgatattaatagcagagctttggatttagctacaaaaaatgcagagaggaatggtgttatcgctaaaatttatcaatcaaatatctacgagaatgtggacgaaacatttaatcatattgtttcaaatccacctattcgggccggaaaatcggttgtacatgaagtaattgctggggcttttcaacgcttagaggcacacggaaccttgtccattgtcattcaaaagaaacaaggcgcaccgagtgctaaagctaagatggaagaggtgttcggcaactgccagattataaagaaagataagggttactacatccttgaaagtgtgaaagaatgagagcagttgatttaattcaaaaaaagcgtgatggcttagaactatcgtctgaagaaatcaaatggttgattgatggatatgtagctgggacagtaccggattatcaaatgtcagccttagcgatggcgatttattttaaagggatgtcaacgcgtgagatttctgatttgacgatgtccatggttgcaacgggtgaacagattgatttgtctgcaattccaggcatcaaggtagataagcattctacaggtggtgtcggagataaggtcacactcatcttagcgccattggtagcaagttttgatattccagttgcaaagatgagcggtcgtgggcttggtcatactggtggaaccttggataagttagagtcaatcaaaggataccagattgaagttagtcaagcagatttcatcaagcaagttcaagatactggtgttgcagttattggtcagtcagataatcttgtcaaagctgataaactactctatgcccttcgtgacgtgacagcaaccgttgacattattccgctgattgccagctcagtaatgtctaagaaaattgccgcaggtgcggatgcgattcttctagatgtcacggtgggagaaggtgccttcatgaagactgttgaagaagcacgggttctagctcaaactatggtggatcttgggaaagcggttggtcgtaagacagttgctgttttaactgacatgtctcaaccagttggaacttcgattggaaatcgtttggaaattttagaggctattgaaattttacagggtaaaggtcgagaagatgttaccgaatttatctgtgaattagcccaaattatgttggggcttgctaatgttgagaaaagcattgaagaagtacgtcaacatattgacaatggtgcagcattgaagaaatttgaagagatggtccgtgctcaaggtggtgacttagaagatttatatcgcccagttcaggttacacagcaagttccagttcttgcggaagaggatggctatattgtgggacttcctgctttggaatttggtctctttgcaatgaaacttggtgcaggtcgtgcagtcaaaactgacaatttagattatgaaacgggtattgttttccataagaaagtgggggaagctgtttctaaaggcgaacaaatcgcaacgatttatgccaatgaaaatatttcggaaaacatgcttacaaatttccaaaaaaatgttaaaatagataaagaaagtgtaaaaacaaaagaaatcatcgagattatttcttaatgtacggagaaagctatgaaattgaataaatatattgaccatacaatcttgaaacctgagacaacacaagagcaggttgaaaaaattttagcagaagcaaaagaatatgattttgcaagtgtctgtgttaacccaacttgggttgctttagcagctgaaagcttgaaagatagtgatgtaaaagtttgtacggttattggtttccctctcggagcaaacacacctgctgtaaaagcgttcgaaacaaaagatgcaatttcaaatggagcagatgagattgacgtggttatcaatatcggtgctctgaaaactggaaattacgatttggttttggaggatattaaagctgttgtagcagcaagtggtgataaactagtcaaagttatcatcgaagcatgcctccttactgatgatgagaaagtgaaagcttgtcaattatctcaagaagctggtgcggactatgttaaaacatctacaggattttctacaggcggtgctacagtagcggatgttgccttaatgagaaaaacagtgggtcctgacatgggagtgaaggcttcaggtggtgcacgttcgtatgaagatgccattgcctttatcgaagcaggagcgtctcgtattggtgcgtcatcaggcgtggcaatcatgaatggagcacaggcggatggagactattgatttaattgaattagctgtaaaaaacagtcaaaaagcatacgtaccgtactcaaaatttccagttagtgcagttcttgtagctaagacaggggaaatatttacgggtgtaaacattgaaaatgcaagctttggtttgaccaattgcgctgaaaggacagctattttcaaggccatttctgaaggtgtgaaagatttttctgaaatcattatttatggtaaaacagaaaaaccaatatctccttgtggagcttgtcgccaagttatggcagaattttttgataaggatttaaaagtgaccttggtcgctaaagataaatcgacagtcgagacgacagtcggggaattactaccatattcctttacagacttaacgtagtctgtatgacagtcatttgactgtagcaatattactctgcaacaatgtagttgcaaaaagatttttaggagggttcagaaatgaacaagaaacttgttggactgggtctagcagctgctgcggctgtatctttggctgcatgtggtaaccgtgcttcaaaaagcagtagctcagaagcatcttcatcagcggacacatctgtgaaagctgctatcgttactgacattggtggtgttgatgaccgttcatttaaccaatctgcttgggaaggtcttcaagagtggggtaaagcagctagtctttccaaaggtaatggctacgattacttccaatcagctagtgaatcagattatatcacaaaccttgattcagctgttgctggtggttacaatcttgtgttcggtattggttttgccttggagagtgcgattgctgaggttgcaccaaataatcctaatacacactatgtaatcgtggatagtgttgttccagatcaagacaatgtagttagcgtaggtttcgcagaccatgaagcatcatatcttgctggtgttgctgcagctaaatcaactaaaacaaatcacgtaggtttcattggtggtatggaaggtgttatcatcgatcgctttgaagctggtttcgttgctggtgctaagtctgtaaacaaagacatcaagattacagttgactatgcgggttcatttggtgatgctgctaaaggtcaaactcttgcagctgctcaatatgctgcaggtgcagatgttattttccacgcttctggtggtactggtaacggtgtatttgcagctgctaaagcagaaaacgaaactcgtaatgaagcagataaagtttgggtaatcggtgttgaccgtgaccaatcagcagaaggtacatacacttctaaagatggtaaatcttctaactttgtattggcttcaacattgaaacaagttggtacttcggttaaagatattgcaactaaggcagctgcaggtgatttccctggcggtcaagtacttcaattctcattgaaagataaaggtgttgaattggcagaaactaatctttcagaagatgcttctaaagcagttgcagatgctaaacaagcaattttggatggcaaagtagaagttcctgaaaaaccttaatgaatttcttttcgacaattccgattcggcgacccgacggggcgccgttttcgggctgagatttttgtcagtaaagcctatcagctatggtaggttttactgacaaaaatggtatagttgatgaagagtttttaagtactcaaagtagtactgaagaattttcagaaggctatagtcagaaaggataatagattatgactaaggattatgtcattgaaatgcgcaatatcactaagatatttggtgaatttgtagcaaatgaccacatcaatttgaatgtcagacgtggtgaaatccatgcccttcttggtgagaatggtgcgggtaaatctactctgatgaacatgcttgctggcttgttggaacctacaagcggtgaaattgttatcaacggtcaatccgtgaagattgactctccatccaaagcagcccaattgggtattggtatggtgcaccaacactttatgttggttgatgctttcacagttgcagagaacatcattcttggttctgaaaccaccaaaggtggcgtgattgaccttaaaaaagccatcgcagaaattaaagaactttctgctaaatatggtcttgaagttgatccaactgcaaaggttgcagatatttctgtgggtgcacagcaacgtgtagaaatccttaaaacactttaccgtggagcagaccttttaatttttgatgagccgacagctgtattgacccctgcggaaattgcagagctcttgaaaattatgaaagccttggttgaagaaggtaaatctattattttgattacgcacaaactggatgaaattcgtgcagttgccgatagtgtaacagttattcgtcgaggtaaatcaatcgaaacagttgccgttgaaggagcaacaaaccaagatttggctgagtggatggttggacgttccgtttcctttaaaacagagaaagttgaagcgagtcctaaagaagtcattttgtcaattaaggatttggttgtcaatgaaaaccgtggtattccagcagttaagggcttatcgcttgatgttcgagcaggtgaggttgttggtattgccggtatcgacggaaacggtcaaagtgagttgattcaggcaatcactggtttacgtaaggtaaaatctggctcaatcactatcaaaggtgaggaagtagttggtaaaactccacgtaaaattacagaaatgcaagtgagccacgttcccgaagatcgtcatcgtgatggactcgttcttccgatgactgttgctgagaactttgcgcttcaaacttactataaagaaccgatttcaaaaaatggtatcttgaactataatatcattaatgaaaaagcacgcgcgttaatggaagaatttgacgttcgtggggcaagtgaactcgtcccaatcaaggctctttcaggcggtaaccagcaaaaagctatcatcgcgcgtgaaatcgatcgcaacccagaccttttcattgttagccaaccaacacgcggtttggacgttggtgctattgagtatattcgtaagcgtcttattgcagaacgtgataagggtaaagctgttcttgttgtcagcttcgaattggatgaaattttggatgtatcagatagaattgctgttatccatgatggtgtcatccatggtattgttgaacctgctaagaccaataaacaagagttaggtgtcttgatggcaggtggacatattgagaagggagaagaacatgcttaataaatataagaatttggcccttccattaatggctgtggtcagcggtatcctacttggagcgattgtcatgcttgtttttggctacgatccaatttggggctatgaagagttattctattcagcttttggtaatatcaaatcaattggtgaaattttccgtgcaatggcaccacttgttttcactgctctcggtttcgcagtagctagtcgtgcaggtttcttcaacgttggtttgtctggtcaggcctatgttggttgggtttttgctggatggtttgccttggcaaatcctgacttaccacgtccagttttgattttgggaacagtcttaattgccatgttggcaggcggtattgctggagctattccaggtattctacgtgcctatttgggaacaagtgaagttatcgttacgattatgatgaactacatcttactctattcatgtaactatatcattcgtgatgtatttgcagatagtttgatgaaaaatacagactcgacagttaacgtgtcagcaaatgcctcttaccaaacagagtggctccgtgcattgacagataactcacgtatgaatattggtattttctttgccattattgcagtttttgtgatttggttcctattgaccaaaacgactcttggttttgagattcgctcagtggggcttaacccaacagcatcggattatgcgggtatgtctgcgaaacgtacgattattctatctatgattatttcaggtgctcttgcgggtcttggaggagctatccaaggtttgggtactttccaaaacgtttatatccaaagtggtaacttggatattggttttaatggtatgtcagtagcgcttttagcttctaattcaccgttaggtattccattggctgcctttctattcggtgttctttctgtcggtgctccaggtatggtacgtgcacagattccacctgaattgatcaacgtggttacggcatcaatcattttctttatcggtgtgaaatttatttttgaacaattattaaaatctagaaataaagcgaaaggagcgaaataagatgaatgtttcaattcttgccttactcatttcgcaaatgttgatttattcagcgcccttaatctttaccagtcttggaggagttttctctgaacgcggtggtattgtaaacgttggtctagaaggaatcatggttatcggtgcctttgctggtgttgttttcaatatcgaatttgcagggacatttggtaatgctactccattattagctgttattgtaggaggtcttgctggtgttgtctttgctgctattcatgcgatggcgacgattaatttccgtgcagaccacgttgtatcaggtacggtgttgaaccttttggctccagcattgggagttttcctagtcaaggttatctataataagggtcaaactgatagtattactgaatcatttggtaaattttcattccctatcttggcagatattccaatcattggtgaaattttcttcaaaaatacaagcttgatgggttatgtagctattgcaacagcatttcttgcttggttcatcctttataaaaccaagttcggtttgcgccttcgttcagtaggtgaacatccgcaggcagcggatactttgggaatcaatgtctacgctatgcgttatgcaggtgtgttgattgctggtttccttggtggtgttggtggagctgtaagtgctcaatcagtgaatatcaacttctctgcaacaacaatcgtaggttcaggtttcatcgctctagcagctgtaattttcggtaagtggaatccaattggcgctatgcttgccagtctattcttcggtctttcgcaaagtttggcagtagtgggtggacaattaccaggattgaaagatattccaacggtttatcttcaaattgcaccgtatttgattactgttattgctctgtctgctttctttggtaaagcagtcgctcctaaagcagacggtatcaactatatcaaatctaaataaaaaggtccagtggacctttttatcatgttctttgctgtacaggaaatgaataattgtcctattcaaaggaagaggagctagagggacttttagttgagaatagggagaatgactggtataatagtttgtcactaaggtatgaaatgagattaattgtgagacgattggtgttaaatattgcaatgagtttagatggatttattgcacgtaaggatggaagctacgattggattgaagggcatggtaccgataaatacgatactgtcttacagtttgataatcaaaaattctttaacaactgtgatacagttgtgatggggagaaaatcattagaagattgtccgttggaaatgattgaaggatatcaggaaaagcaatttatcgttgcgagtcataccgagcagacggactatggtaatgtgcgtttcgtaagggacatcatcgggtagattatggaacttcgttctagagaaggtggagatatttggttgtttggtggagcaagtctggttcaggactgtttagaggcgggagtgattgatcaccttattattgggattattcctactattttgggtgacggtattccacttttcgcctcacttttggaagaaaagaaattgctcttggtagagtcaactgtcacagatggaattgctatgttacgctatgatattagaaggtaaaaaaggcgagctattgctcaccttttttactattttatataattagttttttacaccagctgcaatttctgggtttgcgaaagcatcatcgatgatgtctttcaattgtttagcagatgcttgcattttttgcaattcagcgtcactcaatgggatattgactggacgaacgataccgtgtgcgccgatgatagcaggttgaccgatgaagacatcttcaacaccttcatattgaccagcttggtaaactgacaatggaagtactgcattttcatcatcaaagattgctttagtgatacgtgcaagtgcaacaccgataccgtagtaagttgcgccttttttgttgatgattgagtaagctgcatcacgaacagatacaaacaagtcaacaagaccttgctcatcaatatcgcggttgtcttgcaaccagtcgtacaatttcacaccggcaacgttggcatgtgaccaaactgcaaattctgagtcaccgtgctcacccatgatgtaagcgtgaactgaacgtgcatcgataccgattttctcggccaatgcttgacggaaacgagctgagtcaagagaagtaccagaaccgataacacgctctttagggaatccagagaatttccaagttgagtaagtcaatacgtcaacagggttagcagcaacaaggaagataccgttgaaaccagagttaacgatttctgtaacgatttgttggttgatacgaaggtttttctctaccaattcaaggcgagtttcacctggtttttgtggcaaaccagctgtcaatacaaccaagtctgcgtcatgagcatctgaatactcagcagagtagatttttttagggaatgtgaaggccaatgcgtggctcaagtcttctgcatcaccttgagtacggtctttgttgatatcgatgatacccaattcttgaccaatcccttggttaacaagagcataagcataagcagaacctacggcaccgtcaccgacaaggattacttttttgtgttgtttagttgcagtcattgctaaacatctccttagttttatttggggatgacttcatcccaaccataatacattctagcatgttttaagctttttgtcacttgtgaaagcgcctttgaaaatgtttacatgctagtttccaacaaagaaatttattcgccaatatggtataatagaagcacaatgactgttgaaagaggcatataatgcaagataaaaatttagtaacggttaatctgaccaatgagatgaaatcatccttcatcgactatgcgatgagtgttatcgtttcacgtgctctgcctgatgtacgtgatggtctgaagccggttcatcgccgtattttgtatgggatgaatgaattagggattacaccggataaaccacataaaaaatcagcccgtatcacaggggatgttatgggtaaatatcacccgcatggagatagtgcgatttacgaagcaatggttcgtatggcacaatggtggagctaccgtcacatgttagttgatggtcacggaaactttggttccatggatggcgatggagcagccgctcagcgttatacagaagcacgtatgagcaagattgcgcttgaaatgcttcgtgatattaacaagaacacggtaaattttgcggataactatgacgcgagtgaacgtgagcctgaggttttacctgctcgtttccctaaccttctggttaacggaacgactggtatcgccgttggtatggctaccaacattcctccacacaacttgggtgagactatcgaggcagttaagctggttatggacaatcccgaggtaacaacacgtgagattatggaagtcttgcctggaccagattttccgacaggtgccttggttatggggaaatctggaattcaccgtgcttatgaaactggtaaaggttcaatagttcttcgttcccgcacagaaattgaagaatatggaaatggtcgtgaacgcattgttgttacagagtttccatacatggtcaataagtccaaggttcaagaacatattgtcaaattagtccaagaaaaacgtattgaaggaatcactgctgttcgagacgaatccaaccgtgagggtgtacgatttgttatcgaagttcgtcgtgatgcttctgctaacgttattttgaataacctattcaagcaaacacagcttcaaaccaactttagtttcaacatgttggccatccaaaatggtgtaccgaaaattctttctgtacgtcagattctagagtcttatattgaacaccaaaaagaagtagtcactcgtcgtacacgatttgataaagaaaaggctgaggcgcgtgctcatatcttagaaggcttgctgattgctcttgaccatattgatgaagtcattcgtattatccgtaattcagaaactgatgctattgctcaagctgaattgatggagaaatttgacctttctgaacgtcagagtcaggctattcttgatatgcgtcttcgtcgtttgacaggtttggaacgcgacaagattcaatcagaatatgatgagttagtggccttgattgcagatttggctgacattctagctaagcctgagcgtgttgttcagattattaaagacgaattagaagaagtcaaacgtaaatatgctgacccacgccgtacagaattgatggttggtgaagttctatcccttgaagatgaggacttgattgaagaaacggatgttttaatcaccttgtcaaaccaaggctacatcaagcgtttggcacaggatgagtttcaagctcagaagcgtggaggacgtggggttcaaggaactggcgtcaaggatgatgattttgtacgagaattagtctctacaagcactcatgatcgcttgctcttcttcactaataagggacgtgtttaccgtctcaaaggctatgaaatcccagaatatggtcgtactgcaaagggacttccagtggtcaatttgcttaaattggaagaaaacgaggcaattcaaaccattatcaatgtaactaaggaccaggaggcagatagctatctcttctttgcaacccgccaaggtgttgtaaaacggactagtgtgtcagaatttgccaatattcgccagagcggtctgaaagctttgaatttgaaagaagacgatgaactcatcaatgttttcttaacaaatggccaagcagacattattatggggactaagttcggttattctgtacgtttcactgaaacagatgttcgtaatatgggccgtacagcaacaggtgttcgtggtatcaatttacgtgagggagaccagttagttggcgctactatgatttctgatgaccaagaagtactcgtattgacggaaaaaggttttggtaaacgtacaccagccagtgagtatccaaccaaaggtcgtggtggtaagggtatcaagactcttaaagttgctgataagaatggttctctggcaggtttgacaacggtatctggtgatgaagatattatggttattaccgatactggtgtgattattcgtacaagtgttgccaatatctctcaaactggtcgttcaaccatgggggtaaaagtgatgcgcttgaatggtgaagcgaaaatcatgacctttgccttggtagatgctgccgaaattaaagaagaaaaggaataaatagtcatgtcaaaacgtgaaaacaagaagaagcgtaaaggttctttttggcgcaatcttttaacagttgtattgatactgatttccttggcattgatattcaacacctctatccgtaattttattatcggctggaatacgaataaataccagattagcaatgttacgacagaggatatcgaaaagaataaacaggctgagacaacatttgatttcgaacaggttcagtctatttctacagaagctattttagcagctcagtgggatgcacaacgcttacctgtaattggtgggattgcggttcccgagcttggtatcaaccttcctatttttaaaggggtcttcaatacttcgctcatgtatggagctggtaccatgaaggaaaaccaagagatggggaaaggaaattatgcgttggccagccaccatatttttggtgtaactggtgcggcagatgttctcttttcaccgcttgatcgtgctaaaaacggcatgaaaatctatattactgacaagaccaatgtttacacctacgttattgatagtgtggaaattgtttcgcctgaaagtgtctatgtcattgatgatgtagaaggacgtacagaagttacgttagtgacatgtacggactattatgctacgcaacgtattgttgtaaaaggagttcttgaatcaaccactccatataatgaaacggcaaaagacatcttagattccttcaataagagttataatcagtatgattatggacaataaaacatctatatattaaggataaagaagtggtataggactgaggagataatctttggttttatatggcttcttttttgcaagattttacgaatagataggtgaggaggaaattatgtatcaaattgaatttaaagaagaggcctttctacctagagaacgtttagtagaagttggagctgagcgtctcagtaatcaggaactactagcaatttttattagaactgggacaaaaaaagaacctgtttctattctctccaataaattattgaatcgtttggagagtttagcggctctaagagaactatcaattgaagaattgcaaagtttgactggaattgggcgcgtcaaggcgattgaaattaaggctatgattgaacttggaaaacgtatcaatcaatcagagctactcttaaatgagagaattttgggaagtgagaagttgggacgtaagatgattcatgaaatcgggcataagaagcaggagcatctagttgcactttatctcaatacacagaaccagattatcagtcaaaaaacgatttttattgggagtgttaatcgtagcattgcagaaccacgtgaaattttgcattacgcagtaaaatgtatggcaacatcgattatcatcgttcataaccacccgtcgggttcagtacaacctagtaggaatgatttgctatttacggagaatttaaaagagtcctgcgaaaagctaggactggtattattagatcatttaattgttggaaataaggattactattcttttagagaagaaagtgagttattttaaagtttattgacaatatagtggaagaggtctttttcaatctcacgtttaccgtagagtagttcaggatgccattgaacccctaaaaatttagttgggtaggctgaatgaactgcttcaataatctgttgattatctgatagtgcaatgatttctaagtcaggggctaagtctttgatagcctgacggtgaaatgagttcacactcggatcggactcatatatgtcgtaaagtggactattttgagtcagttgaatcgtttgactgacttcttgtccgtctatgtcttgccaatgttcagaaattgattgatgaaggctaccaccttgagctacattgtagagctgtagacctcggcagataccgaagataggtttctgattttcttgggcagcccttatgagggctaattcaaactcgtcacgctttggtagataattatcgctgtcaatagtcctttcttcgtgatagtaacttggctggacattttgtcctcctgttaggatgagtttgtcaataagatgaatataatattttgccaaatctggctctgtagctggaaggatgagtgggagcccaccagcatcttcaatagcttgtacgaggcaagtctgggtataagaaagcaggggttctgtatgatcccctgttttatattcatttccagaaataccaataactggttttttcattgcttatccttttcgcataaagtagagtagtgtctgtaattcactagtcaaatcaacatactgaacaacgacatcttttgggacagacaagttaactggtgaaaagctcagaattcccttgacaccagcttcaacaagaatatcggtcacttcttgtgccttgacgctgggtaccgttagaatggcggtctgagagtttgcttcgctgatacgttccttgatttctgagattgcatggattgggatattttcatctgtcgttccaacagctggattatcatctgcttcaaaagccatgactattttcattttatttcgttcgtggaagcgatagtgtagtaaggcccgccccatattcccaacacctacaagcataacattggtgatggaggtatcatttagaatatccgcaaagaaatccatcaactctttgacgttgtagccaaagccacgacgaccaagctctccaaaataggaaaaatctcggcggacggtagctgaatcgattccgatagcttcggcaatttcttttgaactagctttttcaatatttcctgcatagaaacgtttaaaaatgcgatagtagagggatagacgtttggcagtagcgcgtggaatatcagattttttatcgtttttcactttagactcctttatttcgatagaatacgctttatcgattatttatatattaaacagttctttattctattctagtccaagtttgtgaaaaaatcaacagattgattttaaaaaaagattaaacaggaaactgtctaatctagtgtttgtaaatagcgatagagatctccgattgtccctttgtaatccagagcttgtccgttttgtgtaatgctggtaactggataatagtctgggagggttaagcaaccggaaaaagccagaatggctgcatccttattctcaaatgtttggatacgttcttgcttgtaagcgtcaagatagtgaatttcaatcatactaactctcttttgtaaagatgtcacggtcaatcaagctatccatgaggaaatagaatttttcttgaataaccttgttactttctggcttaaaaatgtttaccagatgaagaccagacttgtcggtaatgttaattttaaaaccagttaggtcttgattgataataattttcaagaggaatccttggtttgaatttggaatttcttccagaagacgtgtaagctgatagtgacctgctttggtttgttcaaaggtgttatcacggagtgtatattttttgatagcagggctaatgtgataagtaaaattacaatcttttaaggtaactgattgttggaatgccattttaacctccaagtattttctttagttcgatgataagagtatctatctcttcttttgtattgatttcagataggctgatacgaatggattctttcagacgatgggagtcttttccatacatagcttctaaaacatggctattttggacaacacctgccgtacatgcagaaccgctagaaacagcaatacctgccaaatctagttgcataaggagttgttcattaagtttaccaagaaaaccgatattaaggacatgagggagatgaggtccagcctgattgagataatagtctaagccagacaatccctcgataatatgttgtcgcagttcactgacatgttgatgatgcgtatctaaggactcatattgttctgttagggcagtcgccatagcagcaatagcagggagattctcagtacctgctcgatgttgctgttcctgctttccgccgtggatcaaggaatcaaatttatgaactttactatacaggaatcccatcccctttggaccatggaatttatgggcagaagccgcgagcaagtcaattccgtagtcagagggagaaattgcaatttttccaattgcttggacagcatctacatgaaagacggcctgatgatcggctaggagctctccaatttccttgatgggaagtagctgaccggtctcattgttagcaaacatgacgctgactaaaatagtatctggccgaagggcatccagaatttgttgagcggtgattacttgattgactggttggatataggttacctcgaacccaaaccgatcctctagatactgcatggtatggaggacagcatggtgttcgatagccgtagtaatcaggtgttttcctttggattgatgcgcaagtgcatagccttgaatagctaaagtatcagcttcggagcctccagatgtgaaaataatttgttcgggagaggcggagagaatctgagcaatctcttgacgactttgtctaagacattgattggctttccgaccgctttgatgaatactggaggggtttccataattttcttgagccacttccatcatccgttggagtgcagtaggagatagagcagtggttgctgcattatctaaataaatcaaagagttactcctagttttctttttcaggactagtaaatttgaaaagtgggctgagtggctgatgttcttggatgcggtggatggcatctgcaatcaagtcactagctgttaggaaggcgatatttttaggatgctgttctttgcttgcaacagaatcggtaactaatatttctttgattggtgcttcatctaagagttgggctgcagttcctgcaaagagaccatggctggcaactgcataaatttcagtagcgccaccttcttggacaatttttgaagcttgtgagaaagtgcgaccagtattgagaatatcgtccaccaaaatagcttttttacctgcaacatcaccgataatatagccttcagaacgctcagaatcatcttgagcgtagtcgataatcgcaatcggtgcatttagaaattcagcgatattacgcgcgcgtttgataccagaatttttaggactcacaatgacgacatcttctccgcagagtcctttttccatgtagtaggctgcaaaaagtggttctgtaaggagattgtctactggaatatcaaagaaaccttgaatttgtgaagcgtgcaaatcaagagtcaatacacggtcgacaccagctttaaccagcatatttgcaactaatttagctgtaattggttcgcgtggagaagcggtacggtcttgacgagcatagccgaaataagggatgacagctgtaatagtgttggcactagcacgtttacaagcatcgatcataatcaataattcccacaagtgattatttaccggatagcttgttgattggataatgtagacgtctacgccacgtacagattcttcaatgttaatttgaatctcaccatcagaaaactgacgagaagacagctttccaagaggaattccagcagaatcagcaattttttcagcaatatcacggttgctattgagtgagaataatttaatgttatgttcaccgagtggttgtaccattttaaagtaactccttttacacactgagcttttatgatgacataaaagtattttttacgatagatagttctattctatcaaaaaaatgaaaaattttcagtagtgaaactaaaaaatcaaccttagttggctgattttttatagttatttcatgtgggcagcagttcgtgcgaccttactactagcatatttgaattgaattgatttcttcttaaggaattcatcaaaaagaattttccctgcatctgcatcggtcacttcgacttctaattcgtaatctttttgtcccacataatcattttcatcgagggccataaggcctatagatgtctgtttctcatagcgttttgtcgtgaggattccccagacagcaagtttatcaagtggaatttcggttgcagaaataatgtcagaaatttgtcctgctggtagttgaaaattttccagtaaatcatgagcagtttggatgtctagaacttggttatattcttgattgccgacttcttgtggaatttttaaggttagttctgctgagtcctcaaatgtacgaatacggagtgaaaagcggtgattcttcatatctaggtctggggtatcaatgtagtggtttgtttgaagaattgggctcacatctgaaaagtcagtaagcaggcgtttgtattcggatttggtcagtaaggttttatactcaatttcaaggtggtttttcatgcagtaaaccctttcaatgtgttataatagattagtctttgtgttattctaatacaatttaaaagttttgacaagaaaggggccgtatggactttaactgggaagaatttttagacccctatattcagacagttggtgaattgaaaatcaaactgcgggggattcgcaagcagtatcgcaaggctaatcggcattctccaattgagtttgtcacaggacgggtaaaaccgattgaatccattaaagaaaaaatggctctgcgacatattaaattggaaaatcttgctcaagatatgcaagatattgccggtcttcggattatggttcaatttgtggacgacattgaagaagtattagctattttgcggaaacgcaaggatatgcaaattgtgcatgaacgggattatatcaataatatgaaagcctctggctaccgttcatatcatgtggtgattgagtatcctgtggatactataaatggcaacgagacggttctggcagaaatccagattcgaaccctttccatgaatttctgggctacaattgaacattctctgaattataaatataagggaaattttccagaagaaatcaagaaacgcttggaagttacagcaaaaattgcttatgaattagatgaggatatgcgaaaaatccgcaacgacattcaagaagcgcaggccttatttgatcctgcctatcgcaaactgaatgacggtgtgggcaacagtgatgatacagatgaagaatacaggtagaaaaaaaatcgctctgctcgctagtcgaaatcctaagagtgaagcggtgtccaaagaattatggacaaagttaaaagaagcaaattttattttgactcctaaaaatccagatattgtcatttctatcggtggagatgggatgcttttatctgcttttcacaaatatgaaaagttgattgatcgtgtacgttttgtaggaattcacacgggtcatttggggttttatacagattatcgcgattttgaagtggacaagctgattgaaaatcttaagcttgatacaggtgctagagtatcgtatccgattttaaatgttaaggtcaagatgacagatggtcgcattgtcgaggcgcgtgccttaaatgaggcgacagtaaaacgtctttctaagaccatggtcgcagatattattattaacaatgtgcccttcgaacgctttagaggggatggaatttcggtttcaacgccgacaggctcaacagcctataacaagtcattaggtggtgctgttttacatccaacaatcgaggcattgcagattgcagaagtggcaagtttgaacaatcgtgtttaccgcaccttgggttcatccgttgttgtccctaaaaaagacaagattgtgattgaaccaaagcatagtgaccgttactcgattgcggtagacaataagacttttgtctatgatagtattgaaagtatagagtatcagatagacaatagtaagattcattttgttgcaacaccgagtcatactagtttttggaatcgggttaaggacgcctttattggagaggtggagtaatgcggtttgaattcattgctgaccagcatactaaaataaaaacttttttgaaaaaacatggtgtttcaaaaggtttgttggccaaaattaagtacacaggtggcaatatttgggtcaacgatattgagcaaaatgcaacttacttgctagatattggagatagggttacaattgacatacctgctgaagaggatttgactggtagtttaaaaccgattttctttccgttggatattgtctatgaagatgatcattttctggcgataaataagccggttggctacgcctccattccttctgctttgcattcatccacaatcgcaaattttgtaaaaggttatcttattgagcagaattatgagaataagcaggttcatattgtgactcgtctggatagggatacatcaggcgtcatgctgtttgccaagcacggctatgcccatgcacgactcgataagcagttacaggccaagcttattcataaacgttattatgctttggtgaaggggaatgggcagctagaagagacaggggatattattgcccctatcggtcgtccagaagacagcatcattacccgttgtgtgacaaagaatggaaaatatgctcatacttcctatcgtgttgtgcaatcgtggggagatattcatttagtagatattcaactacatactgggcggactcatcagattcgtgttcatttttctcacattggatttccattgttaggagatgatatgtatggtggaagtttggaatgtgggatagaacgtcaagccttgcattgtcataatttggccttcgacaatcctttttcagccgaaaggattgatttggaagcaccgcttcctgaggattttcaggctgtcatcaatcagttaataagtaaataaatttaaggagtttgttcatgaaaatttttgagcaattagctacaaagctagagggtaaaaaagtacgtatcgtattgccagaaggtgaagaaccacgtatcttgcaggcgacaaaacgtttggtaaatgagtcggatgtagtacccgtcttgcttggaaacccagatcgtattaagatttaccttgacattgaagggattacagaaggttttgaaattattgacccagctcattatgatagatatgatgagatggtagctgctttggtagagcgccgtaaaggtaaggtatcagaagagcaggcacatgagttgttgaaagatgtgaactactttggtgttatgttggtatatatgggcgtagtagaaggtatggtatctggtgcgattcattcaactgcttcaacagttcgtccagctcttcaaatcattaaaacagagccaggtgtatcgaaaacatcaggtgccttcttgatggtaaaaggtgaagagcgttatatttttggtgactgtgctatcaacattgatccagatgctcaaaccttggcagaaatcgctatcaactcagcacgtactgctaaaatgtttggtattgatccaaaagttgcaatgctcagctattcaacaaaaggatctggctcaggtcctaaagttgataaggtggttgaagcaactaaaattgctcaaaaattgcgtccggagttggatttggacggtgaattgcaatttgatgctgcctttgtccctgctacaggtaaattaaaagcaccaggttcgagtgttgctggtcaagcgactgtatttatcttcccaggtatctcagctgggaatattggttataaaattgccgaacgtatgggtggatttgcagcggtaggtcctgttttacaaggtttgaatcagcctgtaaacgacttgtctcgtggttgtaaccctgatgatgtttacaacttgaccttgattactgcggttcaggctttggagcaccgttaatatgaaatttttatcacgatattttaaggactatattaaggaatccatattaggtccagtttttaaactattggaagcttgttttgagcttttggtaccattaattatcgcctatatcgttgatacaattattccaaatggcagccagggaaacctggttgctatgctttttttactggttggtatagcatgtattggaattattgtttcactaatagcgcaatattattcagctaaagcagcagttggagtgactaaagagctgacgaatgacttgtatcagaaggttctttcccttcccaagtctagccgagatattctttcctcatccagtttgctgacacgattgaccagcgacactttacaaattcaaacgggtattaatacttttcttcgtttgtttttacgtgctccaattgtcgtatttggttcgctcatcatggcattctatattagcccaagtctatctgcctattttctaggaatgattatcctattgatttttatagtgacagtcatttctgttatgaccagccgtatttatcaatcgatgcgaaaagaattagatggtttggtggggcaggtacgtgagaccgtgactggttggcgagtgattcgtgcatttggacaaagagagcgggaaattaaggcttttcaaggcataaatcagatttataagaagcaacagttgcaggctggtttttggtctagtcttttatcgccattgacatttttggtggtcaacagcaccttactcattctcatctggcaaggaaatatagccatttcacacaatttgttggaacaggggatgttggtcgctcttatcaactaccttcttcaaattttagtcgaattggtcaagatgattatggtcgtgtctactctcaaccagacctatatttcagcgcaacgtattcaagaggtgtttgaccaaacatctgaggatgtagagtctagtttgccaaaagtggttagtgaggataaggaaatcatcttttctgtgcgtcatctttccttttcttatccaaaatctgctgaggagtccctgtctgacattacttttgacttacgtaaggaacagtttatgggaattatcgggggaactgggtcaggtaagtccaccctagtagatttattgcaggcactctattcagtgccaacaaatcagctctctctcttcattgatggaaaaagtcctaagaatttaaaagagtggcggcagcgaattgccatcgttccgcaacaggcccagctttttgctggaactattcgttctaatttatctttaggattggaagaaatatctgatagtgacctatggtctgctttagaaattgcacaggctaaatctttcatagaggataaaggtggtttggatagccctgtcgaagcctttgggaagaatttttctggtggacagcgtcaacgtttgaccattgcacgcgctattttacagaaagcaccgattttaatcttagatgatgcaacatctgctctggattatttgacggagagtcgattattagctgctattcgccaggaattaccaggtcagaacttaatcatggtgtcacaaagaaccaatagtttacggacagctgatcagattttggtcttggaacaagggcgtcaagttggacttggtcgccatgaggacttgctgagaagctctgctatttatcaagaaattcaccaatcgcaacaacaaggagaggaggatagctatgagacaatctagttttaaggaactggtcagattggttctacaccagccccttcgaatgtccttgatgttggtgggaactttggtgcaagtccttctgacagtttatctgcctatcttgattggtcaggcagttgatgcagtattgatagcaaatggtcaggtcttgctcggtatcttaggcaaaatggtgatggttatcttgcttaatacactggtgcaatggtacttacctttggtaaccaatcgcttggtttacggaatggtggccgacttgcgtgaacaggtctatgtgaagctgcaccagatgcccttatcttatcttgatcgtcaatcagtcggtgacttggtggctcgtttttcaagtgatagcgagcaattaacaaatggtctcttgatgattttcaatcaatttttcattggtatctcgaccattttcctaaccattttcactatggctaggcttgacttgacgatgatgttggttgttgttgccctgactccagtttctctgcttgtggcacgctatatcgctaagaaatcctatggttattataggcaacagactcaggcacgtgggaggcaatctcagcttttggaagagtccatcagtcaattgacactggttcaatctttcaatgctcaagagcaatttacgcaaggttttcaagttgtgaatgaccagtatgcgacctattcccaacaggctatctttgcctcttcaacggtcaatccaagtactcgctttgtcaatgctattatttatgccttacttgcaggacttggagcgctaagaattatggcaggaaattttacagtgggatccctgacaaccttcctcaattatgctagtcagtacagcaagccttttaatgatatttcctcggtcctatcggaattgcagagcgccttagcttgtgcagacaggctgtttgctatcttggctctagatagcattgacgaccaggctgagcggaaaattgattcagaggagttgaagggagctatttcctttgacaatgtgtctttctcatatagccctgaacgttctctgatagaacatttggacattgctgtcaaagctggacaaaaagtagccattgttggacctactggtgctggcaaatcaaccatgattaaccttcttatgcgcttctacgatgtgacggctggtcagattgtcttagatggggttccgattagccagtatagtcgtgaggatcttcgcagacagattgggatggttttacaggagacatggatcaaatctggtaccattcatgataatattgcctatggctatccaaatgccacgcgggaattggtcattgaggcggctaaggcagctaatgcagacttctttattcgtcagcttccgcagggctacgatacagttttggcagatggaggagaaggcttatcccagggacaacgtcagcttttgtctattgcgcgtgtctttgtcaagatacctaaaatcctgattttagatgaggcgacttcctctattgatacacggacagaaattttagtacaggaagcatttgccaaattgatggaaggacggaccagttttattattgctcatcgcctatcaaccattcaatcagctgacttgattttggtcatggtggatggaaaaattgttgaacaagggaatcatgaagcgttgatggctgaacaaggcgtttattatcaaatgcaaacaagtcagcagacagaggaggatgaaagtgttagataaattaaacttacaaccgattacggttttagatgactatcaagctacaatgctcaatgagaaagaggtgctaatgaccacaaaggtgacggaaaaatctctcaatccatacggtatggcacatggaggctttcttttcacattggcagattcagttgcaggtctgacaacggtagcaagtggttcttattctgtcaccctacagtccaatattcattatatgaaggcagctaaacttggtgataccttatcagtaataggctcttgcacacatgatggaagtagaacaaaggtcgtcgaagttaagatagaaaaccaagataaacagctacttgcttcagcaagttttaccatgtttgtaacaggaaaagtagaataaaactcttcgaacatcaaaagcagacagtcttggctagatttagaaaaacaaattcgttcgctctatttccaacctccaaaggttccccaaacctttggagctagtttgattttgattataaacgatataagggagttggcaaaagctggctccctttctttgtgttatactagatgtatgttaaatttgaaagaatatggaatcgaaatgtggccggaggaaaagattcaagcttttcgcaaagcactcttagattggtatgatgccaataaacgtgacttgccttggagacggaccaaggatccgtatgctatatgggtttctgaaatcatgcttcaacagacaagagtagacacggtcattccttattatgaacgttttctccatcacttgcctacgattagtgatttagcacaagcaccagaggaggtcattctcaaactctgggagggattgggctattattcgcgcgtgcggaatatgcaaaaggcggctcagcaaatggtagaagattttgatgggcaatttccgaccacgcatgcagccatttcaagcctaaagggcattggtccttatactgctggagcaatttccagtattgcttttaatttgccagaaccagcggtagatggcaatgtgatgcgggttctcagccgcttgtttgaggttgattatgacattggtcttcctgccaatcgcaagattttccaagcgatgatggagctattgattgattcagagcgaccgggcgatttcaaccaagctctaatggatctagggtcggatattgaatcgccagttaatccacgtccccaggacagcccagtcaaagcctttagcgcagcctacttaaacggtacaatggataagtatccaatcaaagcaccaaagaaaaagccgattcccgtggcctaccagggatttctcatcaggaataaagacaatcaatttttattggaaaaaaataatgaagcaggtcttctatcaggtttctggtcttttccgcttttggaaaaaggagcaatcgttgacaaacaagtctctctctttgaagttgcagaagaagttgttcagccagatattcggcagagctttacggaactttatggtctgactgttgattggcaagagcaagaatttggcatcgtccagcacatttttagtcaccgcaaatggcagatagaaatggtagaaggtgtggcagaaacacttaaccttccagaatcaaaagaattgaaatgggtttctgtagaagattttcctacctacccatttgctaagccgcaacaaaaaatgtgggaaaactttatcaaggaaaaagaaaagcaaaaaagttgactttggagcacataattatttgaaagcgttttataatagtggtataatctaattgaaaaaaggaaatagttagttaagatgttgaacgccatctgaattgctgaaaggagttctttagcgttcgtagaagtgtatatactattagccatctttctctaataaaaagagagggatgctagtaggggaaaagtccgttatccctgttttatatctatttgtgatatccattgtcaaatgcatagcattaactcattatttagccttgctacccggttcaatcagaagtaggctaagattattcgtgtcgtaactactatgtgttcaagatgttgtaacttttgaacataaccttagaaaatcacaaaaacctctagcgattttcatcataataagcaatctccacactttagacaaatagtaagaggacaatcaaagacataagggtagcagaataattatttaatcattaacttgttgtcaaataactatctggtaatggacttttccaatttgacatataaaaaggaggctgtcatagcctccttttactgtgcttttcaatttgttttcagtaggaaaaaacgccagctatacggacagactttccaaaactagatggatgaatgtagcatatataactagtgattaactaggcttaaaaatcaatctggactataaatatctacaacttgaccaataggtcgaatatcgtcttctgggctaaaatagatatcatcatagtcagaattgagtgattgcaaatagtcacctttgaactttttaacaaaattttccccattgactgaaaaaattccaatcgtatttagaggaatatgaggagttaggcgaatgaagagatagtctccatcctcgatatgcggagccatagaatctcccacaacctgagcgattgtatcataagattggttatctggaatctcatcgttatagaatgatacaagattgttcatatctgtatcctgccagtaacctgtaccggcagaaaccttaccaggaacaggtaattcgattcgctcccgatagtcatccaagtgaagaatagaagcagaaggagtaactgaggcagtttgcatagctgctaactgttcttgaccaaaagttaaccattgtgcatggaaatcaccttttagttcattgtccaaggttagaacctctggatgaataggctgttgaaagagtttaaattgggaaggagtaatcgttaaagctatatcctgattggaatctagttgctcgattagctcaccaaccgatatagccatgcccttagcgactttttctagcgtatccatcgttggcaggagagcttttttggttttgggatgctggttcttttccaacatagaaatataaccttttgttaaaccagataattcagcgaatttatccattgataatttattcttgcttcggtattcttttaaaatatcacctaaaatcatgattgtctccttatctgtttaactaattataccattaaaaaatattttttgcaaattttgtttaacgtgtttaacaaaaaatcaaaacggtgttatgataatctcacaaaaagaaaaataggagtcgcaaatgaaaaggattacagagatttcttggaatgatatttataaagagtgggaaacctatgctaatcattttggtttggcgactccgataaatactgaaaaattgcgaaatcagaaatcgaaggattttggaaaaggaagtctgattacgctggacttattagccgattacgatactgattttgagaagaccgcagctatttgggtagctttattttgtagagatttaatacaagattacgcatatttactaaatggtagagcctatcttacagtcaatcagatttattttcaggcactcaaacaattccagtcagaagcggtaatatggtcaaaacctctcacatgattgcaaccgaagttatttgtatcttatcgtttgttggaaaatcttgatttgagtcattattcttgtgtagttgagttagcaatgttgtaggctagtatggttcggacacagatattagaaaagtaattatagtaggagaatgaaaatgtttaatttgttgaataagaaagctgaagtatcgaaagttgcagagtattggaatgataccttgatagaaagaggaattttgagcgctaatgaattgctcgaaggaaaatgctggagatgtaaaagttctcatggtgtaaatatgtgtcagattgtatcaagcaaatggagcaaggatacgagcctggctaatcagatggtcctatgtctatcctgtcagcatgaaaaacctaatgtagctgatacagaaattgtgtggcaatggttagaagttgagaataatgaacgttactggactctacaaggtatggcagaatatgagaaaatgtataaaaaatcagtacttcaagagttatgggatatgggaattcgagatggtgaagaagtcgatacgcttgtaaataaagtaactagcctttctcgtaagaatgatattgttttaaatagagcaaccttagcaggattatttcgctgtgaaatcgaacaaatgcgtcgaaaggcatttctaaattggacaggaatttttaagctagtcagttaaccgatacagttgtaggaaaacatctcatgctgattggagtaacagataaataaaaagcgcatcagcttagaatcttaaagaaagaagtctaatgatgcgtttatagggttatatttcagctaataaaattggagtgaatgtttttgaattatagctcaaaacgttaatccaaacgttatggcgacaacatttgtgccgactttttggttcaaattggttcaaatgtttactcgcttaatgaattcaataaatttaaggcctcagcatcttgctggtgtcttttttctggcatcaattctagataatactgttgtgttgttaagatagagttatgacctagacgacgagaaatatagtctaggctaatatcttttgaaaagagaaatgaggcatgcgtgtcacgaagtccatgaaatgtcgtttttgttaatcccaactgttttaacagcttttgaagttgactagcttgcttgaatccatttcaatcaaagatatagccttcttttatttgtgcaagctttgtcacagcttgataaacatcttcgttgatggaaatatcacgcttagaatatttggttttaagctgggcatcgtcattagttggactaattgatcgaagaattttgataccatattcaaaaatatcttcttttttaattcctaaaagttctccgcgccttgctcctgtctcaagggcgagagcaacaagaacattaaattcatcctcagtatgacttaggcagtattgtctgagttttttaaattctgtgatagatagtggtatatttcgtttaggttgttcttgtccttttgatttcaaaagatgaccaaaatcattactaatcaaaccacgagcatacgcatattttaatgaaccatggattttaagaacaagttcttttactgtttttttagagtgggtttcagcgtattggtcgattttcttttgcatgacgagatcgtcaaggtgtttaagttgaataccatcaaaaaggtcatcaactattacgagagttcgtttatagttaataaaggtggcttcgcgaacgtcagttttcttgaccgtatggacccaatttctataaaaatcaggaaatagggtggagcgttcggcaatgtttttgccacgacctttttcaagttccatttctaatgtccaaagctcagcatcttttctgttgctaaaggttttagtttctcgtttatattctcctttcttataaagtgatacagttgcacggtaagagttaccacgttttgttattgttgacattttatcagcctttctataaaaaatgattgataaaatagactagtcacatataggatatatgaaaaatctaattttatcaatcattatccgtcaatcgcagtggctttcaataaatttaaccagttttgacttcaaatagcgctcttgttttcccaccataaagcattgaaagtctgggtgacttctaatgtacttaccaaatgatttaggatctattccaagtagttccgctacttgttgtctatttaacagaagaggagaattattttgaggtaacatataaaattcctttcattttctagatataagtattatgccacatgtgcaacaaatcgaggcttgatttttgaaaaatgtacaatgtttcctaacgtttcaataaaatataagcataggaatgtggaaattcctctggtctattgtgtcccagagcctttgttacaattttacaagcttttctgtcgagcgagatgccaactaactctttacgcagatggataatttctttacgatttctaatcttggaaatttcgcgtgctacactgcgataaacacgctctgcatactctgcaggatatttgtgtgactttaatgctgttggaactttctttccatcaaaatcgtcgaggattaaatctttgggaacatgaaagactttcttttttcctgctcgttggaaaatagcgactaaccactcttcctcctcttgactagtggccatgattggagaccagcgatctctgcgtccttttgtgtgatgcttatggccggctaaatttaaataccaacggccatcacggccgcgttgcagagcatcgccagtgacgtggattaattcacttttgcgtaagcctgtcgaggtaactactttatgccagtagtcgttatttttgttggataaacgatagtctttatgtaatacacgattgttcatacgattcgcacgagtacgtggttgtgtagcgatgaaattagttgaggaaactccgagaactttggccaatgctactttgtaggtagcttgtgtatatggacttaaaccaatctctatacaatattgtaagtattgattgataagttctatccaaccttccgtatctttttcaacattacctaatgccattaactgttctggcgaaatgttaattgaaacccattttgcaaaacaatgctatgaacctgaatagttatggagtgtacgatgagtatggattaactcaatgctttcttttttccttgcagtcggttctaacgaaccgatgttttgcgaactgcgcaaaacctgctcgcgaagattgctcgcataataaagttgtaattatcatttaaaataatgttcaaaattccaacatattcttgtttatttttgatataatgtaaaaaaacaacaaaggattaaacatgaataaacgagaacgactagaagaaattacacgattggtaaacaaaaaaggcacagttcgaatttctgagatagtagaattgctaaatgttactgatatgactgttcgacgtgatttcattgaattggaagagcaaggtgtcttaacaaaaattcatggcggtgctagaagtaataaggcttttcaatatcgagaatattcccattctgagaaacacattcagaataaggaagccaagcaagagatagcggaaagggctgcacaactgatagaagatggagacacggtatttttaggtccaggaacaacagtggcctttctggctgaggccattaaaaatcttcgcctaactgtcatcacaaattgtatgcctgtttttactatcctatcacaaaagaagacagaggattttcaagtctttctccttggaggagaatatcggcaagtgacagaatcttttgtaggagaaattaccaatacaagtttagaaaaaatgcgattcagcaagattttcttttcaggtaacggacttaagggaactgatgtcatgacctctaccctagcggaagcctatacgcaaaatattgccattaaacattctttagaaaaatatctactgctggatgccacgaaaattggaaaagatgattttacttctttttgtgatttgaatgatgcaactgctctagtgacagatatgaatgcaaaggatgaaaattaccaattattaagtaatcacattgaaattatttctacaaaatcataaagttatcaaaaccaacagagaaatgttgtttttttgtttgtatacgaaaaaaacaaacaaaaataaaataaaatatgttgactttgtgtttgtttggttgtataatttaaacataaaaagcgaaaacgcttttctaagttttgcaaaacaaagattttctgccaaatatggctacaactttctatttttgttaggagataagttatgacaatcattatcggtgctgatccagcgggctcaaaactaaaagacgttattaaagattatttgctagaaaaatcatatgactttaaagatgtcagtgatggaagtgattttgttgatacaactttggcagtagttgcagaagttaatcaacaggaaggaaatcttggcattgtgattgatgcttatggcgttggtccatttatgaccgcaactaaagtcaaaggcatgatcgttgcagaagtttcagacgaacgctctgcctatatgacaagaggacacaacaattcgcgtattattacaatcggtagtgagattgtaggagaaggaattgctaaaaatatcgttaaaggatttgttgaaggtgagtatgatggtggccgtcaccaaattcgtgtcgatatgctaaataaaatgtgttaatggttgtaaacaaaggagaataagagatgaaaattgcaatcggttgtgaccacattgtaacctatgaaaaaatcgctgtggtagattatttgaaaaatcaaggctatgaagtattggactttgggacttatgacaatgttcgtactcattacccaatctttggtaaaaaagttggtgaagcagttgtgagcgggcaagcagatttgggaatttgtatttgtggaacaggtgttggaatcaacaatgctgtaaacaaggtacctggcgtccgatcagccctggttcgtgatatgacctctgcactctatgcaaaagaagagttaaatgccaacgtcattggttttggaggaaagattacgggcgagctgctcatgtgcgacatcattgaagcctttattaaagcagaatacaaaccaactgaagaaaacaaacgcttaattgaaaagattgctgcagttgaaacgctcaatcaagagcaagctaatccagagttctttacagaatttcttgaaaagtgggatcgtggagaataccacgactaggaggctcacatgattttgacaatcactttaaatccgtcggttgatattgcctatcacttggatacctttcatttggatacggtcaatcgagtagaaaaaagttcaaaaaacagctggaggcaaggggctcaatgtcacacgagttttgaaacaaattggtgaagatatagtggctactggttttattggtggtgagattggaagttatgtaaagaaacaactcactcgaaatgatattaaaaattcctttgtggaaattgggagcgaaacacgtaattgcattgcgattcttcatgatggcaaacagacggagattttagaacaaggcccaattattcaagaacatgaagccttgaattttatagaacaccttgaaatcgtcctgaacaatgtagatgtagttgtcatttcaggaagtttgcctaagggacttgctagcaattattatgttgagattgtagaactttgtaaaaaatacggtgtagctgttgttttggattgttctggtgaggcgctgaaaaacgttttagaaagccagcagaagccgacagttattaagccgaatacagaagagttatcacaactgattggtaaagaagttactgatgatattcaagagttgaaatcagttttgtctgatcaacttttccaaggaattgattggatagtcgtctcattaggagcaaagggggcttttgccaagcacaatgacaagttctatcgtgtcagaattccaaaaatcaaagttgtcaatccagtaggatcaggagattcaactgttgcaggtattgcagcaggtttggtacatgctttacctgaagcagaattattaaaaaatgctaatgttttaggcatgttaaatgctcaggaagaacagacaggttacgtcaatttagaaaatgcagaatcgttgtattctcaaatcgaagttgaagaggtataatatggtagtaacagcagataaaagaaaatacatggaaaaagtaagcaatgaagcaggtattatttcagctttagcttttgaccaacgtggagccctgaaaagaatgatggcaaaacatcagacagaagaacctactgtggagcagatggaagaactaaagaaactagtttcagaagaattaacacagttttcttcctcaattctgttagaccctgaatttggtttgccagcatcgcgcgcccgcgatgaacaatgtggtctacttttagcttatgaaaaaactggctatgataccagctctactagtcgattaccagattgcctagtagagtggtctgtaaaacgactaaaagaagaaggggcagatgcgattaagtttctactctactatgacgttgatggggatccatacgtcaatcttcaaaaacatgcctatattgaacgcttaggttcagaatgtcaggcagaaggtttgccattctttttggaaattttgagctacgatgaaacgattgaagacaatgccagtgtggaatttgcaaaagtcaaacctcgaaaagtaaatgaggctatgaaggtattttcggacgaacgatttggagtggatgttctcaaggtagaagtacctgtgaacatgaattttgtagaaggctttggaacaggggaagtcgtttatacaaaagaagaagcagccgaatatttccgtcaacaagaagcatcaactcatttgccttatatttatctaagtgcaggtgtttctgcaaaactcttccaagatacactagtgtttgcacatgaagcaggtgctaaatttaacggtgttctttgtggtcgtgcaacatgggcgggtgttgtgccagtctatattgaacatggtgaagaagctgcgcgtgaatggttacgaactgttggtcgtgaaaatatcgagggacttgatgtagtcttgtctcaaacagcaacttcttggctagaaaaataattgaaaaaataaccattttcttaaaagaaagggtttacattttctgagaatatgctataataatctcatcagcaagaatagagtggattgtaactaattcgattaggcaagactacaaatggatttgagagtaggatattctcggtttgtttgtagtctttttttgcttaaaaatataggagggatatatgtttaggattatacagtcactaaataataacgctgccctggtgaaaaatgaacatggggaacaggcagtcgtgatgggattaggtataacctttcaaaagaagaaaggggatttaattattaaggacaagatagaaaatatcttttcgctaaaaaatgatgaagccaaagaaaattttctaaccttattaaaagatattccattagattttatttcggcaacctacacggttattaatcatctagtagaaacttatcattaccctgtacaagaatatctatatgtgacactgacagatcatatctattgtgcatatcaggcggttttaaagaatacctatcaagaaagtaggctacccaatatttcagccgaatatccattggaatataaaatggcgcgtgaagccttagctatgtttcgtgaaaagttgctaaatgattttccaaatgatgagattggtaaaattgcacttcacttaatcaatgcaaaaggtgaaacaattcatcccacaagtgaagaacatgatatcagtaagaaaattattgctgaggttgaacaaattttgatagataatgggattagacgctcaaaagaaaatagcaatttttatgatcgctttatgattcatttgtcctattttctgaattacttagatagatcccatcagtcaaatgaatcgattgctagtttggaacagtacatcaagctccagaatccaagagcccatcaggttggaagtcagatttttgagatgattacatcattggttgatgagccagtaaatgatagtgaaaggttctatattgtgttacatattcaacggttattgtaaatcaattcaattttaaaaggaggttcatattatgaacagagaagaaattacgttattaggttttgagattgttgcattcgctggtgatgctcgttctcgtttgatggaggcactggctgctgctcaaaaaggtgattatgcaaaagcagaagaactagttgaagcggccaatgcttgtattgttgaagcccaccatgctcagacaagtttgttgcagaaagaagcggctggtgaggatttagcctttagtgtgacgctcatgcatggtcaagaccatctcatgacaacgttgttattgaaagatatgatgagtcatatgattgaactttacaaacgaggtgataagtaatgaataaattgattgaattcattgagaaagggaagcctttctttgaaaagatttcgagaaacccttatttaagggctatccgtgatggttttattgctgccatgccggttatcttgttctcaagtatctttctattggtggcttttgttcctaatatctttggttttacttggtcagatgaagcagttgcagctatcatgaaaccttacggttatacaatgggtattgtagctgtcttagttgcaggaacgaccgcaaaatctttaacagatgcgtttaaccgtcaattgccaaaaaccaatcagattaacttcatttcaaccatgattgcctcaatttcaggtttcttattactggcttctgatggtattgaaggtggatttgccaatggttacatgggaactaagggacttttgacagcctttctagcagccttcattacggttaatatctataaggtctgtgtgaaaaacaatgtcactattcgtatgccagacgaagttccaccgaatgtatcccaggcatttaaagatgtgattccatatgcattgtctatctttgtcttgtatggaattgatcttgtgacacgtcaattccttggaacaaacgttgctgaggcgattctgaaattatttgagcctctgtttacagctgcagatggttatgttggtattacaattatctttggtgcctatgctttgttctggtttgtagggattcatggtccatctattgtggaaccagcaattgcagccattacttatgctaatattgaaaccaacttccagcttttacaagccggtcaacatgcggacaaaatcctgacttcaggtactcaaatgtttatcgtgactatgggtggtacaggtgctaccttggttgtgccattcatgtttatgtggttgactaagtctaaacgaaataaagcaattggacgtgcttcagttgttccaactttctttggtgtaaacgaaccgatcttgttcggtgcgccacttgtactcaacccagtattctttgttccattcatcttagctccaattgctaacgtatggattttcaaattctttgttgatacgctaaaaatgaacagtttcagcgttaacttgccatggacaactccaggaccattggggattgtaatgggaacaaactttgctccacttgcctttgcactagctattttgttggtatttgtcgatgtacttatctattatccattcttgaaagtttatgatgagcaaattcttgctgaagaacaatcagggaaagttgaaaatagcttgaaagagaaagtggcagctaattttaatactgccaaggcggatgctattcttgaaaaggctgcagtcgaaaccgaaatttctgaacaaactaatgttttggtactttgtgcagggggtggtacaagtggattacttgccaacgctctaactaaagctgcaaaagaatatggtgttccagttacagctacagcaggaagctatggggcgcaccgtgagattttgccagagtatcaattagtcatccttgcacctcaagtagcatcaaactacgatgacattaaacaagaaaccgatgcattgggtattaaacttgccaaaactgaaggggctcaatacattaaactcacacgagatggtcaaggtgctcttgactttgtcaaacaacagttttagaacctatattcacagttcagcacttccatctaaggctagtttttcagctactcatcgttagtttttttcaaaatacagtcagtattccctcaaaaaaacgccttgattagcgaaaaaccatctcttatatacaagtatatacaagcacttcacttgtgaatacaggttcttaatcaaaaggggagggagttatcatctccaactcctacccctttatttatttttgatagaagaaggtaggcatatggttaaaacattaccgaaagattttatatttggtggagcaactgctgcatatcaagcagagggtgccacaaagacagatggaaaaggtcgtgttgcgtgggacaagtatctagaagataattactggtacactgcggaaccagcttctgatttttataatcgttatccagttgatttagaactaagtgaacagtttggggtaaatggcattcggatttcaattgcgtggtctcgtatcttcccaacaggctttggagaagtgaatccaaagggagtagagtattaccataaattatttgcggaatgccataagcgtcacgtagaaccatttgtaacacttcaccattttgatacaccagaaacgctacattctaatggtgactttctaaatcgagaaaatattgagcacttcgtcaattacgcagcgttttgcttcaaagaattccctgaagttagttactggacaacctttaatgaaatcggtccaattggtgatgggcaatatctagttgggaagttcccaccagggattcagtatgacttagctaaggtattccaatctcaccacaatatgatggtttcacatgccaaggctgttaagctttacaaggatgctggttatagtggagaaattggtgttgtacacgcattgccaacgaaatatccttatgatccaaccaatcctgacgatgttcgtgcagcggaactagaagatattattcataataaatttatcctcgatgctacatacttgggttactattctgaaaaaacgcttgaaggcgttcgacatattctgaaagtaaatggtggggaattagaccttcgtgatgaagacttcgctgccttagatgccgcaaaagatttgaacgacttcttgggcatcaattactatatgagtgattggatgagagctcatgatggagaaacggaaattatccataatggtaaaggtgaaaagggaagttctaagtatcaaatcaagggagttggtcgtagagaatctccagtcgatattccgaaaacggattgggattggattatctacccacaaggtctttatgatcaaatcatgcgtgtaaaaaatgactatccaaactataagaaaatctacatcactgaaaatggtctaggctataaagatgaatttgtagatggtacagtctacgacgatggtcgaattgattatgtgaaaaagcatttagaagtgatttcagatgctatctcagatggtgccaatgttaaaggttatttcatctggtccttgatggatgtattttcttggtcaaatggatacgagaaacgatatggattgttctatgttgactttgagacccaagaacgttatccaaagaaaagtgcttattggtataaaaaagtagcggaaacacaggttattgaataaaactaatacaaggatgcctagctcaagttagcatccttgttttcatataagggaggcagtttatatgctcgaattaaaaaatgagaacttaacagtacaattttctgaattaggtgggcaaattatttctattaaagacaaggatggtatcgaatatctttggcaaggagaaccgacctattggagcggtcaagcaccagttctatttccgatttgtggaagtttacgaaatgattgggctatctatgaacctgcagaaagaccgacatttacaggcacaattccaaggcatggacttgtgagaaaaatgctgttcaaaaatgtaaaaagtactgaaaactctttagaattttctatttcatcaaacgaagaaaccgtaaaaaattacccttttgaatttgaactttctattaactactcactatttggcaaaacaattcgaattgaatatcgggtgaaaaaccttgagggacatagaaagctaccttactttattgggggtcacccaggttttaattgtcccttgttggatggtgagagttatgaagactattatttagaatttgaaaaagtagaatcttgtacagtacctagaagttttccagaaactggcttacttgatctgcgagatcgccggccattcttggaaaatcagaagaccttggacttgtcctataaactgtttgagtatgatgccataacattggatcaattagcatcacgaaaggtaaccttgaaatcaaaaaatcatcagaagaaactttcgattgcatttgatgattttccatatttagtgatttggtcaactacaaatcagagtccctttatcgcattagaaccatggagcggactctctacatcactggaagaatctgacatattcaatgccaaacgaaatattagttacgtcgctccaaaagaggttgatacaaaatattttgatattattattgagtaaataccatagttaagtaatttaaatattctacggaaaacactcaaaaaccccactggctgaataagtcagtggggtttattgcttaatttaatattatgaaaaattaaattaagtgttgcagggtgttcagctgtattttgagaaaactttatcaatgacttaattacgagatgataaagcgatacaaaaatcgtagtagatgtattcctatggggtatgatatacttagtgagagaggacattacatatgcttgtaatctcgaaaatatttttgaagcagaatgaattatcagtttgagtaaaagtaagaagatttattaaataggtgttagcttatgaatgattgtgatttaaaagattttgtaggaaaaaatttcgctgatgaattaccagatgatgactctaaaataatgattcattttcatactatgatacttgaacttggatcaataattgctgcacttgaaatagtaaaaattgtaaacgatgagtggcatgatagagtagtgcaatcatctattagatatgatatagtacgaaatgtaacatatgaatctttattttatagagttgtcttcggtataactaaaatttttgatgtcagagaaaaaaatggtatttttaagattctatctaagttgagacatagtaccaaagatagatctcttttatcaattttgagtaccattcaagagggtattgataaagaacaaaaaaatattgatgaaatcaaattgcttcgcgacaaactcttggctcacttagataaagagatggtcttttcaacagaaagattagacattggtattctatactattattttgaggctatagaaattaagtccatatatacggcttgtatcgagttatataatgcttttatatagagataatcagcaacaagtcgaacttcctaaaagagaaataattttgaaaagattttttcttgaagaataactcgtattgattagttttttttgtcttcttatatcgataaatttataaaatacttgacctatcattttgaatttgattaataaattatccatctataagataaagtaggtcaaattagtttgacctactgatgactagtctattttatggtgttaattggtgtcgattttatccaaatcagaggattttagtccattttcatggaagtttcattttcgtaaatgttgatataacgggatttgtaaggggtgagaattcttcgttttcaatagcaaaattctctaaaaatcagggaggttattcgatgttggaaataaaacgattctcctttctagaaaatcggtaaccgcaatgttgacaacgataataagtccgatcagcttcatagagcattgcaaacatagctccctctatgccattgattgcatgaccaatcataccggctttacgagaatatcttttttgtgttggaatgtaagtttgcagttttattgacttacattttggacatttgagcgcttgtttagtgtccatattattaggatggcatctgcgatagatgctataagagattattagtactatgaggataatcggaccgatatattctattaaggtattcataatcttattgtaaatcgtgtccttattttattcaaggaaaatgaatattattttttctaaaataactgatcctatggctatagttgttaactatatatatctctaatatttaagtattagtcaagatggtaaaaatgaggtagaatacagaaaaagaccaaaggagtacctttatgactagagaattttcatttgaaacccttcaactccatgctggacaagaagttgattctgcttcaaaatcacgtgcagtacccatctatcaaaccacttcctatgtttttgaagatgctcaagaagcagaagatttatttgcattgcgtaaatcagggaatatctatactcgtatcactaatccgacggtctctacttttgaaaatcgtgtggcagctttagaaggtggtattggtgccttggccacttcttcaggaatggcagccatcacatacactattctagcattagcgcatgctggtgatcacattgtggcggcaacgacactctatggtgggacttttaacctattcaaagaaacccttcctcgctatggtattacaacaagctttgtagatattgatgattttgaagcggtagaagctgcgattaaagataatacaaaactggtatttattgaaaccttgggaaatcctgttatcaatattcctgatcttgaaaaattggcagaaattgcacacacctaccacatcccacttgtttcagataataccttcgcaaccccatatttgattaatgtattttctcatggtgttgatattgccgtccattcagcaaccaagtttatcggtgggcatggtacgaccattggcggtgtgattgtcgatagcggtaagtttgattgggcggcatctggtaagtttccgcaatttgttgaagaagatccaagctatcataacattagttatactcgtgatattggtgtagctgcatttattgttgcagttcgtgtacaattacttcgcgatacaggtgcagccctttctccattcaacgccttcttgcttttgcatgggttagaaaccttgtctctccgtgtagagcgtcatgtgtcaaatgctgaaaagattgttgatttcttgctcaatcaccctaatgttgagtcggtcaattatccatcacttccagatagtccttataaggctttggcagataaatacctgcctaaaggtgttggatctattttctctttccaagtaaaaggcggagcagaagaagcccgaaaggttattgatggcttggaaatcttttctaatttagcaaacgttgccgatgcgaaatcactagtagttcatccagctacaaccacgcatgctcagttagctccggaagatttacttgctgctggggtcacaccaaatcaaatccgcctatctgttggtcttgaaaatatcaatgatttgattgaagatttgcaacttgctcttgataaattataggttgtgaatcgaatagcttggcttcattctttatgaataaataataaaaggaaatttggcgtgtgtgccattttccttttttatatctgtcctagttcttccagtccattctcagttagtcgatagattctttgacaaacttctttcaaaaagcgtctgtcgtgtgatacgcataccaaaccacctggataatcggcaaatagttgacgaatatatggctgagaagtgggagagaagtttcgactgggttcatctaacaagagaaaattggcttgatcaagaaccatttttaacaagagtaacttggctttttgtccccccgaaagttcacagatcttgtgatgaacttcttgtcgtgtaaactgcagactggctagatgtgttaagataagttgctcctgctcacgattgccattttctaataaaaaatcaagtggagttttagactcatcaaggacttctgaatagcgctggggcatgtatcccaagtttatatctgctcggtgcctgagtttctgatagattagctttagaaaactggatttaccaattccattttgtccaatgatgccaattttctcttgtccatttatgttgaaatggatattgctaactaattgtcgttcttcaacgttcaattggaagttttctaagtgaagcacttgttttctagctggtagtggtgaaatgtctgagaagaagagggaaatggcatcttcatgaaaaggaacttgtgtaagattttccttcattctttcatagcgtttttcacgtgagagaacatttttcattttcttagcaatgagccgtcctagtgtggcatcatgggtgttgagcaaggtgtgacgaacctgtgatttttgacgtaggtgcttattcatggctttgtcaaattctttttggtcgttccgagcttgctggacctgcttctgataagcttgctggcgtctcaatgcgtaatcctggtaatctagttcttcaaccttggtctgtgcaagtgttttctttttaaccgattctagatgaatgatttttgtagctgttctgctaagaaagtcttcatcgtgagaaacaaataggatggttttaggactagtaatggtatagttttcaagccaaagtaaggtatctaaatccaagtcattggacggctcatccagaaaaataatatcagatggagttgctagagatttgattaactgaatttttagtttttcaccacctgacaggctttcaatcaattgttgactggcaaatcgctcactgtcaaactggagctggtcagcatagaggtagagtaggctgtaatcaatgtcgctgtccaagtcagcgaagaagtagtcgttcagggttagctctgctatttccagtggaagactttggggaatatagactggtgagtgaaaatatcggtgaatactgcctgattgaagcaggtagtcggcgacaagagtggaatccatcaaggtgagtaatagactggattttccgtttccttcttcgccgatgatagctattttatcgccagggttaacaatgaggtttaggtcctgaactagatttcgcaaatctttttgatggtcgagagataggtgatgagtggttagtagcataaggcctcctttacaagaaaaaacacactacctatttagtagtgtgtcgaaatctgctcaaaaagaccctattcatggaacagagaaacagaaaaatggacgcaagaaaactactaaataagtatagaacttaaattgagtttacttgttattgtccatttctccttacctcgcatgctttatttgttttaatatagcatatcgatagaatcttgtcaatcagcgtgctataatattcatagatttcgatagagatatatgttaaaatgaacttattgtaaatgagagaggatccgaaatggcaatcactggaattgagcaagcagatattttagaaatagacaaacaagtccgtttacgtcggtatgatggtcagcatgatttttcttttgaatggcaccaagatctagaattggtctggctgattgatggtgatcaagaacgttatagtcttgacttgctcaatcgtatgtatgattatttgtctaaaaatggcgaatgttactttattgaaatttttgaagacaatcagtttatcccaattggtgatgtgacgctgtttgcagatgattttgccattgccattggagataagcggtattggaaaaagggaattggaaccaaggtattacagcgaatgattgaacgtgcaagagaagtggggcttgaggaaatacctgtagaagaaatatatgactggaatacaggcccccgtaaactgtttgagaaatgtggctttgaagctgttgaaaagacaaagaaaggttggtcctacaagatgatattgtaaattaattttgagataccaaaaaaaacttgacgaaagtcaaagcttcagaacgtagataaactcttaaaaatataaaaaattgaagaagtttgcgaaagatagcaagtcattaaactcttagaaacattgatatttcggcgtttctaagagttttttattttcaacataaagaaaaaagattgaagaaaatcgtccaaaatggactttttcttcaatctgaaaccttgatgcaagtcaaggcttttcgtttagcttagacgttcaagaccttatcaaggaagtcttgtaaacgtggatgttgtgggttatcaaagatttgctctggtgtaccatcttcaaggaactcaccgccatcagtgaagataacgcgattagcaaccttgcgggcaaagcccatctcgtgtgtgacgattaacatggtcataccttgctcagccaagtctttcataacgttgagtacatcgccaaccatttcagggtcaagggcagaagttggttcgtcgaagagcatgatgtctgggttcatagcgagggcacgagcgatagcaacacgttgcttctgaccacctgaaaggctgtctggcatagcgtcgcgtttgtctgccaatccaactttttccaataattccatgccgaccttttcagcttcagacttgtccatcaatttgtgttcgattggcgcaaatgtgatattgtcaagtacagacatatgagggaagaggttgaagtgttggaataccattccgacatttgaacggaaggcgtcaacatctgtcttagggtcggttaagtcatatccatcgactgttacttgaccacttgtaatggtttcaagtaagttcattgtacgaaggaaggtcgatttacctgaaccagaaggaccgatgatacaaacaacatcgccttcatagaacttagcagtaatacctttgaggacctcgtttttaccataagacttgtgtaagtcatggacattgatttttaattgagccattatttgcctcctttttcgagtttgcgtgctaagcgagtcaagagtgtgataactaccaagtaaatgatggcaagaattgcatacatacggaaggattggtagttacgtgcaataatgattttacccgcttggaagagttcgaccaaaccaatcgcagaaatgatagtggtatctttcagagtaataacaaactggttgataaagttaggcaacataattttaccagcttgaggtaggataatcttacgcatggttgttccgtaggaaatacctaaactgcgagatgcttccatctgaccagctggaactgcctgaataccgccacgaacaatctcggcaatataggcactagagttgagggatagggcgatcgtaccagcgacaaagtcattgattggagattgttgaccagtcatcgactcgattaagtttggaataccccagaagatgaatgcagcgacaatcatgagcggaataccacgaacaacatctacaaaaacagatgaagtaacacggagtgctttaactgggctgacagcaaacataccgaagataataccgatcacaattgcaatagcaaatgatagaagggcaagtccaattgtgataccaagacctgagagtaattgaccgtagttgtttttcaaaagaccaacaatcgttgtctcatcaacagttgaagttgttgtgcttgcttcttcagttgagttgaaatacttattaaggatttcatcatacttgcctgattcaactagggcagctaagccgttgttaaacatttcaattaattctgggttggcaccttttttaacggcaaatccgtactcacctgatttttcgccaggaattggtgttgcaaagttgcgaccttgttggatggcatatagaagaaccgcttcgtcatccataagagcatcaatagaaccagagtttaaactgtcatacatacttgaagcttcgtcgaaggcttttagggtgtaaccatattttgacttgttttcttctaagaaactatatgaagcagtaccatttttagccccaacagttttcccttttaagtcctcgtaagaagcgatgtcactaccatttttaacagctaataggatgtttgaagtatagtaggcgtttgagaagtcaaagatttccttacgagcatctgtgatagacataccggcaataactgcatcagcttgtccagcttgaacagcatttagtgcagcgtcgaaaccagggttttgaatagtaatggtaaatccttggtgttcagcgattgccttgattaattccatgtcaatcccgacatagttacctgattcatcttggtattcaaatggagcaaaagaagaatctgccacaattgtgtagcttgatttgacaggtgttgctttagctgatgcgtttcctgttaagcttaaacgagatgagtaatctgtactttcggtagaagtggtagaagctcccaaccatttgttcatgattatttcgtaggtgccatctttcttcatctcagctaaagccttgttaaagtcttcaacaagatattcatattggctacctttttttacagagaaaccaaatgaaccgatggcttcgccttcgatgtcaatacttaggtcttgaccttgttggatagcgtattgaataactgcttcgtcgtccattacagcatcaacagcaccagcagaaaggctattatacatcaaatcgccagtatcaaaagtttttacgttgtatccgtacttgtctttgttttcttctaggaagttttgggctgcagtaccgtttttgacaccgacagtcttgcctttaaggtccttatatgaagagatggtatttacctttgtggtagcgataacgattttggtgtcgaagtaagggtctgagaaagtaaatactttcttacgcgcttcggtgatagttgtacctgccattagggcgtccgcagatccagcctgtacagcgttgacagctgcatcaaatcctgggaagctttgattcatggtccaacctgagcgcttggctacttcgttgatgatgtcaacatctaatcctttataaatttgatctgagtctttaaactcgaatggggcgtaagcattgtcaaatacgacatcaatagtatcgtcagctttaatgccagtaaaaataaagaatactggcagaatgcttgccaataacatgagtaattttttcttcatttccatactccttctattataaaataactgtcctagtatatcatattctgaaaattaatgcaaaattgaggtttttataatgtcagaatttctgacatacaaagtcattaaaatgtgagaaaatttaatattttggacatagttgtgaatggtttagaatgtttctccattagtcgaacttatgataaaataggagtatgatcaatcgaaatactgaaaaccaatttaaacttgtgtcaaaatatgcaccgtctggtgaccagccccaagccattgaaaccttggttgataacatcgaggggggcgaaaaagcccagattctcatgggggcgactggtactggtaagacctataccatgagccaggttatcgcccgtgtcaataagccaaccttggtcatcgcccacaacaagaccttggctggtcagctttatagtgagttcaaggaattctttccagaaaatgcggtcgaatacttcgtgtcttactatgattactaccagccagaagcttatgtaccgtctagcgatacctatatcgaaaaggatagttcggtcaatgatgagattgacaaactccgtcactctgcgacctcagctctgctagaacgcaatgatgtcattgtggtagcttctgtttcttgtatctacggtttgggttcacccaaggaatattcagatagcgtggtcagcctgcgaccaggtcaggagatttcccgtgatcagttgctcaatgccttggtggatatccagtttgagcggaacgacatcgacttccaacggggacggttccgtgtgcgtggcgatgtggtggagattttcccagcttcccgtgacgaacatgcctttcgtgtggagtttttcggggatgaaatcgaccgcattcgtgagattgaaagcctgacaggcaaggttttgggcgatgtggaccacttggccattttccctgccacccacttcgtgaccaacgatgaccacatggaaacggccattgccaagattcaggcggaactagaagagcaactcaaggtctttgaggcagaaggaaaactcttagaagctcagcgattgaaacaacgaaccgactacgatatcgagatgcttcgggagatgggctataccaacggagttgagaactattcacgacacatggacgggcgaagtgagggggagcctccttataccctgctggactttttccctgaggactatctgattatgattgacgagagccacatgaccatggggcagattaaggggatgtacaatggtgaccgctcacgcaaggagatgctggttaactatggtttccgtctaccgagtgcattggataatcgtccgctgcgcagggaagaatttgagagtcatgtccaccagattgtctatgtatctgcgacgccgggtgactatgaaatggagcagacagagaccgttgtcgagcagattatccggccgaccgggcttttggatccagaagtggaagtccgtccaactatgggccaaatggacgacctcctaggtgaaatcaatgcccgtgttgaaaaaggcgagcgaacctttatcactaccctgaccaagaaaatggcagaggacttgaccgactacctgaaagaaatgggcgtcaaggtcaagtatatgcactcggacatcaagaccttggagcgtacggagattatccgtgatcttcgcttgggtgtctttgatgttttgatagggattaacctgcttcgtgaagggattgacgtgccagaagttagtctagtcgctatcttagacgcagacaaggagggcttcctccgtaatgaacgggggctcatccagacaatcggtcgagcggctcgtaactctgaaggtcatgtgattatgtatgcggacaaggtcaccgagtccatgcggaaggccatggaagaaacagcccgccgccgtcaaatccagatggcttataatgaagagcatggcattattccacagaccattaagaaagagatccgtgacctgattagcgtgaccaaggctgtcactcaggacaaggaagaggttgtggacttcaatgctcttaataaagatgaacgcaaggccatgatcaagaaactggaaggtcagatgcaggaagccgcagaagtgcttgactttgaactggcagcccagattcgcgatatggtcattgagttgaagaatatgtagatatggaggtagttatgaaatattttgatacgtcgaaaacaactaatcaagtggtaacctgtattagacaattggaaaatacagagctagaaaaagagttgttacagtttattgaagagtgtgagaaagcagactctctatccaaagagtatatagaacgtttttttaaaattgtcgatgcttttcttgaggtgtttccaggatcatccttggattcgcagcacttaaagaaactcttgactttgctccatgaaaaaataaaaacagaagaggtgtgggcggaaatcttttatagagatacctctaacattagtgcttattctagattatttagggaattaattgttcgagttagcacttatgatcaaattagagattttgttgataggggaagtatttttgggacgctattggaaagtagagaaagtgtgagtcatactgtaaccagactcaatttactaatactgatatatttcgtatttacctttttgtttatttctgatacggataaagaaaagtttaaattacagatagattcctatattcaggaattacttcaatgtgataagtatttagaccaaatggccttattttatttgctatccagcaataaacatattcaaatattgaagagagaagacttacgtataattaatcaatatgtagaaataaatatacaggataatgagaagtttattcaacagtaccttgactatctaaaggaattgggggcagatgcaattgcagaatctcagaaagttctacaagacttgaataagtatacggattctgacattatgaaaagtcagataatagagttactagatttaactatcttgcctgttagcgaacctcattcaagcgaggaaatcgttgagaaaataaagggagctattgatgaaattcgttctgcattgataattgatgcaaagaaattaaaagagaatgaattttatggccactatactacaatagacaccttggttaatttcttatttaaaccagagacggaagaaaataaaaattgtccaacctatttacgtttgtcaaatgctaatcaattgaatgatccgatggaaggaaaagccttactcgccatccttggtttagatgcccatatggaacagtattataaaccaaccaatgtgtttctttcatccttgacagttgttaaagatagtttacctatgtggaaagaatatgctgaggagtctaggggagcatttctggaatatgatcaagattacttggaaactattgtcaagcatgatgttattgaatttgctaaagttcattatattactacagatgaaaagcaaaatattactggtgataaactagttgatcaaaaactaatatatattcaagatacaattaagtatttagaagatgagggagcaaccgatgaaattcgagaaatcattgattatattgctaagatatcctatctttttaaggtttctgattatcaatatgaatctgaatatcgtatattggtaaacttagatgatacgcatttcactaacaaattcactgataaattcactgataaattgaactctggaataaaagatgaagctacacgtaggaaactagatattggcataggattgttagaaaataagaatgtgaattatctgaacagcagaaaatatattcacatagaaaaaacagaacaagggaaatgtaatttatatgcgtacatcaatgttgtcccattaaaatattcaaagattatgttggggccaaaagttgaaaatgtagactatatagctccttatatccattacattcagcctgacattatcgttgaaacttcaagtattccgtatcgataacctcttttgaaaagctacgaagaattgagttagaccataagtaagaaactggaaggtcagatgcaggaagcggcagaagtgcttgactttgaactggcagcccagattcgtgatatggttatcgagttgaagaatatgtagattcgaaagaataaagcgacagggtactgcatcctgtcgttttttatgaacattgcttagtttgtatcagatttgaattgaaaatagttcattgaataagacaaaaaacttgtaggagcatcattgaataggtataatagtttctatactattttagggagtaacaacttatatgaaaagatctttaggtgaaaagcgacaacgctttggttttagaaaaatgtcagtgggacttgtctcagcggcagtgacaagtctattttttgtgtcctctgtggcaacagcaccgactgctagtgctcaatcaatcaattattcctatgtgacagagcaagaattgacagatggagaaaaggagttgattattcgtgacttgcctggcttagctcaggaaacggatgtaaattattacctgatctatcgtccagctactggcacaacatctactccatcgacaagcacgtctcaagttttgccaaatactggctctgtagaaaccgaactattggtggcgggtggagtgtctctcctgttattggctgttagatttggtaaaaaaggtaagaaggagttggcgggtgtcatccttttgacagctacgggagcaagcttcttcggtccaactagctccgcattgacgagtcaaattttggctcgatataaccatgcaatcgaaatatctgccggacaagcgttaccggccccagctgagattgatggctacgtttatgtaggatatttgaaggatagcaaagctattgaacaaactacttcggaagaggaaaaaacagcggaattcccagcttcagaaggaatccgtacagaaactattgtcaacaagacagaggccattccattcgaaattcaaaccgtagaaaatcctcaattatctgcggggacagagcgagtggtacaagaaggacaggatggggagcgtattgtaacgattaaacaagtccattcaaaaggtcaaattatttcggaagaagagatttcctcgacggttacaaaaactgctgttccaaagattgttgaagttggtacaaaacaagcaaccgatgatattgttacagaagtaccagatacagaaccaagttatgaaaactcgacgaattctttaacagaagaaacagttactcataccgaagtctttgcctttgatgtgcaagaaatctatgatgtaaacttggcagaaggtagtcgtgaagttgaacagaagggacaagatggtgttcggacaatcgagactaggaattattatgccgatggtgtactgattaaatccgaacaagtttcagatgtagtgacaaaagaaccagtaacagaagttgtaagagtaggcacgaagacaacagatgttattggatctgaaaccattgtaacaacagaagagcttccgtttgaaacgacagtcacagaaacagaagaactttatgttggggaagaaaaattcattactgaaggtaaggttggttctaaggaagttaccactacttatcagacaatcaacggagtcagtcaaccaaacccaacagtgactgagaaagtccttgaagagccaacaacgaaagaggttctcaaaggaacaaaaccaatagaaggtacggaaatcgaaactaatcaagttgagattacctttgaaacagagtatgttgatgatccaacactgctagaaggtaagaccaaagttgtaacggcgggtgtaaatggctctaagacagttacaacaacttaccagactatcaagggtgttcgtcaggaaaattctactgtaacagaagaaattaccaaacaacctgttaagcaagtcattgcgcgtggtacaaaggttgaaaaagtaccacaagtgattatcacagatttggtggaaaatgacgatgccaagtcagcgacaatcagctacaagttgacagacgaaaccgctaatttccaacgagctgttgctctcctctatgataatacaggtgccttggttcaagaacagaccattacagatccaaatggccagttgacacttgaaaatcttgatttctacacagattacactgttaagactaagattttctacacaatggcagagcaggaacaaagttcggaacaagaagctattcttgaaagcatgcgcaaatttgatttggtctacaagaagattgaaatcaaggatattgatgcggtgactgtttaccgtcgtaagaatggtagctacatcggtcaagaattcttggaagaactgccagcatccacagatgaattgtttatcaaggtgacttcagatcgcttcaaggaggtatacctacctgtgtcaagtattgaagaaactaccttgaatggcaaggcagtcttcaaactagtttcatcctttgatgaattggtacaggataaggatgcccaatacgttgccaatcgtgaattctacattcctaagatggcgactgatgcaaatacctacacatccttcaaagctttgctcgacgctatgaaggcaaatccaagtggtacctttaaactaggagcgcatttggacgcaagtgaagttcctgttggagatgttgcatcgtatgtgaccaactttagcggtaccttggatggcttaaatgacggctacgccttttctatcagcaacttgaaagcaccattgttctttaaccttggtggtaaagttcaaaacttggacatcaaaaatgcaagcctgaatacaagctctaagaacccacttgcgacaattgcgattaatgccaatggagcaactattacaaacgtagcagtagaagcatctatcaaaggaccgcaaaacgtatctggtttagttcattctgcaacaaatactactattaaaggtgtatccttcaagggtagtatcgaagtaaccggaaccaatgcaagtctaactggtggtatcttgggtaacggtacgatggcaagtgtcggaaatgccaaggttgatgcgaccataaccctcccaggtacagagaatcaagtagctggtggtatcgtcggtcgtacaatgcttgtctacgatgtaccaggaagtgtctataattcttatgcagctggttccattgtgacgactgaatcggcagccattgtcggcggaattgctggtgccaaccaagtaacaggtgcctatgctccacatagcggtaatgtcaacaacgttgtcagcgatatgactggtacgaaaagcattatcggtcaacccgcaaatccaactggtaagattaaagacggtttcactacaacatctgatagcttgaccaacgtcactgttatcactgatgaagaagcacaagcaaaagtagaagctatggctattcaagcgacaattgatgattctgtaccgcttaatcccaatcattattcagtagactacttgaccttggataaggcacaggctgaccatgaaactgcctactacaacatggagaaaatcttgccattctacaacaaggaacttcttgtctattatggaaacaagattgcgacagacgataagctcaacaaggtccgtttgctggatgttgtaccaatgaaggacaatgctgtagttgctgacgtctacgctgagaaggctaatatcaataagattatgcttcactatgctgatggcactgtggactacaagacagtttcttatctagaagacttcaagaataatcatgtggtcgagtataccatttcaggtacggacttgatttacacgccagaatcattcttgaatgacagaagtgcccttgtcaatgacttggtaagcagcctttcttctgttgtcctcgactcggatgccatgaaggctgttatcaattatccaacgaccttgaatgccgatactcagactggtacagcaaaagatttctactttggtgaaagctatgaccaagtgatgaccaacctagaaagcaatgttcgtaagattttagtggctagtctaaatggtcaaggtcaggcttctgaagactacatcaaagagaaaatcatcaacaacaaagcagcctttgtgctcggtttgacttacttgaaccgttggtatgacatcaacttcggagagatgaataccaaagacttgaccatctttgaacctgacttcttcggaaatgatgcagcatctgccctagatatgattcttgcaattggtaatggtggctatgatgttcttcgtgcccacaataacgtgaccacttttgcatccatcattggtaaacaaaataatcagaccaagcttttcgatatgctggaagattatcgtcagctcttcttgccagaaatgaccaacaatgaatggttcaagcaaacaaccaaggcttatgttgttgaaggtaaatccttgattccagaagtagctgctaagcaggaaacgacagatacatatagcaagtacaatgttggagcttatagcaagattgtgaatgatactgtatccaatccaacttggaagtacaaccacatgctcttgccactcttgactttgccacaagaaaatatctttatcatcacaaacatgaataccatcgcgattggttcatatgagcactatgtagatgattattcaacagttgaaaatcgtgataaggttcgtcagatggttgatttggcggcagaacgtcagcgtgataatgcagacttctggtataagattttggatgaaaccaaccgtgacaagctattcagatctgtcctcaataacgaaggttatgtgatgtatggtaaagatggtacgaagtcttatcgcaacttgacagctgatgttgatgctatccaagatttctacggtccgatcaataagtggtatcgtgagcatccgtctattaagactgcctttgcggatggaagtgagacctactatattacttacgatatgttgacggattacggtacagctctttatacccacgaaatggttcacaaccaagatggtgatatttatctgaaaggctatggccgccgtattggtcaaggtatggaagtttacgcccaaggtcttctacaaaatgtcttcaatgttactgagatgaaccttggattcaacgctgtctataatagcgatgatgccaaccgtgtccatgtcggagacccagttgcacgtttcaatagcgaagctgatttcaatgagtattaccataaccaatttgatgtactttacttgctggattacctagaaggtacaaacatcttggctcaatcagatgctaacaagaaagcttggttgcgtaagattgaaaactactatgtccaaaataatggtgttgatacccatgctggaaactctgcgcgtgcattgacagatgccgaagtggcaagcttgaagtccttcaatgatttgattgatcagagcattattgttcaacgccaatatgtcaacaatccaactaacacaagcaagaagtgggatagaaacagttatgtcagcgttccaatgtttgcagctaacttctcagccctttcaaactcaaacggttctccaggcgacatcatgttccgccgtatggcctttgaattaattgctgccaaagggtacacagatggttttgtaccgtatgcttctggccagttgtctgatctagctatggagaaaggctcaatcatctatgatacttggaacaagaagaatactggtttgattacggatgaccatgtcttagaatatgtcttccaaggtcaatatacttcatggactgagtttaagaaagccatgtttactgagcgtttggaaaaagcagcgacaggccaactcaagccgtttaccatgcagtatgaacttggtgttgctgattcaaccaaggaagtaactatcacaagctttgagcagttgcaaaacttgatgaaagaggccatggaagcagacatccaagcgaacagcctcaacttgaacaacagtcgtgttcatgcactcaaagtgaaagtttatcaagccttgatgaactctacaaatgacttcagaacatcgatttttaattaaataatcattaacaagttggtcttgtgccaacttgttttttaatgtatactagaggaaaaaattcggaggtcctttagatgatgattaaaccactggaaacgaaaagtgaaatgctaggcaaggcctatgttcattggaaatcatggcaggaggcctatgctgacttgttacctcaggaatttttaaagaatacttacactttagaacgctgtcaagactgggcagttcggtatcctcagaatatcttgatagctgtgatggatgataaggtcgttggctttgcctgttacggctcatctagtcaggaggatttgcaaggggtaggggagctctacgccctctatgtcttggcggactattataatcagaagataggctaccagctcatgcaggcagctttagaaaaattgcagagctacgaaaccgttattctctgggtattggaggggaatgcgcgtgccattgccttctatgaaaaagtgggcttccgatttgatggtgtcaaaaaaacggtcaatttaggtgcagaacgtacagaatatagaatgatttttaaacagaaagagagagaaaatggctagaaaagaaatggtcactttgactaacatgtgtctaatcgaagataaggaagggaaggtcgttgtacagattcgagatcccaagcgttatcgttggtctggtgttgcctttccaggtggacatattgaagaaggcgagaatttccatgattcggttgttagagaagtgcaagaagaaacaggtttaacagtcactgatgctcgcttggttggtcttaaacattggccggataaggaagggcatcgttacattgtatttctctataaggcaacagagtttacaggaactatccgatcaactgaagaaggcgaggtgcgttgggttgagaagtcggaactgcctcagatggatttggcctatgacttactagaaatcctgaaagtcatggatgagccagatttgtccgagttcttttatactagaaaaaatgacgatggagagtgggacaagaattttaggtagaagctaggaatagcttcttttttatgttgtttgaataaaaatacaacaaatgagttgacaaatgtataaaaatgacataaaatgtttttatctttcaaaaaaggagaaaaaatatgcattttactacaatggaagtccgatgttttatataaaaaacggtataagtatgcacaggattattttaaaggagaatatgatgatgaaaaaatatattatgatgggattggttttgttggcaacgatgaccctaagtgcttgcagtggaaatgctactcaagaagatacttccttgaaggatgttcaggaaaagggaaaactaattgttgcattgaatccagaatttccaccatttgagtttagaacactggttgatggaaaagatacaatcgttggagctgacattgagcttgcaaaagccattggtcaagaattgggtgtagaagtcgaattttcagcgatgagttttgataatgttttgaacaatgtccagtcagggcaatcggatattgccatttcaggaatttcagccactgaagagcgtgcaaaagtgtatgatttttccattccttactacacctcaaccaataaagttattataaataaagaggatcttgcacaatatacatcgcttgattctctagctgaggcaaatataggagcacaaaaaggttctattcaagaacaaattattaaagaacagcttccgtcctccacggttattgctctagcttcgaacggcgagctaattaatcaattaaaatcacagaaggtagaagcagttatttttgaagagccgattgcgaaagcttatgttgccaaaaatgatgacttggttattttagatactgagataaaaagtagctattcagatgcctatgctattgccttgccaaaaggaagtacagctttaaaggaaaaagttgactctgtcattacaaaactagtggaatctggacagatggatcaatttgttcaagaagcctatgaattatccattgctaataattaaattttatacaattaaagtgaataaaaataatattttcttgacaaatgtataaaaatgaattaaaatgagaatacattctgaaaaactgcaagaaaatacaatgaaaatcaataagcttctgttttttagaataagtattttattaaaataaagagaaggtatttaagaaatatgaaaaaaatcttggcattagcagcaacagttttagctggactgacattggcagcttgttcttcgacgtcatcacaatccgcattagataaaattaaagaaaaaggaacattagtagtggcaactagtccagactatgctccattcgagtttcaggcactagttgatggaaagaatgaagttgttggtgcagatattatgttggctcaaaaaatagccgacgaacttggggtcaagcttgaagtttcagcaatgagttttgacaatgtattgtctagcgttcagaatggcaaagctgatattgcaattgctggtctatcttattcggaagagcgtgcaaaagtttttgatttctctgaaagttactatcaaatttctgatgtattacttatcaaaaaagatagcgccaattcactcacttcaattgatgctatgagcgggaaaactctcgcggtacaaaagggttcaacacaagaatcctatgcacaggaaaacattagtcaagctaacctaatttctttaaccttgatgggtgaagctgtaaatgagctcaaatcaggaaaagttgatgctattttaatggattctccagttgctgctggttatgtttcacagaattcagatttagccgttgcatccgttgaatttccaacgattgatgagaattcgaaagtcattgctttgccaaaaggtagtacagaactaaaaactgcgatagacaaggttatcgcagaagtaaaagcaagtggtgagtttgatactttccttgagaaagctgcaacatatacaagtgttgaataagagaaatgaacaatcatcggaaacggtggttgtttttgcatgcaaaaaagaatggagtaagtgagccacacaccaaaagttagacagaaaatttgggtcggttcaatactccattttttatagataattatttcacacgctctagataaaaactggtcaaacgtggtacagtaattctggctccattttcatcgggatagaggctaaatgtgtccattggaatagcattagatgagaagacaagtttatattcgctgtcagctggcaaatccaagtgtacatcaaatagttcttgatcattaaagttatgaatagtcaagatttcttgcacatcactagtgcgagaaaaagcatacaggcttgcttcttcatctatttttacccaattaaatcctttttcataggcttggtagtcatatttccagaaagcatcatgttctttatagaaagtagatagtgttttcatcatttgatagaaagaatggtggattggaaattgtagcagtccccagtccatttctgtatattcgtgccattcacggatgtgaccccattcatttcccatgaagagtaatttctttccaggatgggcaaagtaaaagctgtagtagactcgagccagatggaacttatcttcgtagtcgccattcatcttctcgataatggagtgtttcccatgaacaacttcgtcgtgcgaaagtggtagtaagaattgctcgttttggttatagtacataccaaaagtgatttcatttgagtgatattttcgataaatagcagggcgttccacgaattttagtgtatcattcatccagcccagatcccatttcatatcaaatccaataccgccatcttctagaggatgtgtgactttagggaagcttgaagagtcttcagcaatcatcaagactcccttatagtcggtatggaccatggcattgacacgtttgataaagtcaattgcggcatgatttatcttatcttcatctgtttcaccacgccaatagaggagataagatagtgcatcaacacggatgccatcaaaatggaaatattccaaccagtattttaaattagaaagaaggaaagaacgagtcagtccttttccaaggtcaaaattagcagtcccccactggtgattttcacggtcttgttcgtaggagtattcgtatagccaactaccatcaaactggtagagcccatgagcatctttacagaaatgaagtggtacccagtcaagaatcactccgattcctgcttggtgacattggtcaactaaatacttaagttcatctggcttgccatagcgactagttggactgtagtagcctgttacctgatagccccaagacgcatcgagaggatgctcggtaattggcaataactcaatatgtgtgtagttattttccttgatatgttcgatgagaagtggagtaatttccttataactattgaaagcttctacaggagctcctccttcatttttattagcaaatttttgcttccacgaacctaagtgcacctcgtagatggatactggctgttctttaaaatcatagttaacacgattatacatccagatgtcatctttgaatttataacgcgaattgtaggttgtagaggcagtgtctggacgaacttggctgaaaaatgcataagggtcagccttatatatttcacgcccatcgtgtgtgataatcaggtatttataatcttcaagggattttaatccgtctacataaagttgaaatactccatcaatttcacgctccatagagtgactgcgttgccactcgttaaagttgccaactaagaatacttctctggcatttggggcatagacacgaaattgggttccgataattttgtttcgttcttttataatatgagcacccattttttcgtaaagagtggtatgctcaccagtattcatataatataaatctaggtcagtaaattctgtcatagcaatctccattgccgaaaaggagtggactagggtcccactccgattcagtatattttttcatcttatttcctaaccactaatttcacggtagagccagatgtatttctctgccgaagctgtccaactaaaatcacgcttcatagcttgttcaaccatggcataccagtcatcgggacggtcatagtaggtttgaagggctaaatcatagacttgtcgcatattgtaagcgtcacgccctccaaagctaaagccagttccttccttggtagacatattgtatggtgctacagtatcaaccaagccacctgtttcacgcactagagggagtgttccgtagtgcattgaaatcaactggctaatgccgcatggttcaaacatagaaggcataaggaagagatcacttgctgcataaatttggtgggcaagtggttcattgtaaccacggtagaatgcaaatttatcaggataagcatgtttaaagtgattaaaggcattttcaatgtcttcctcaccattgcctaagataacaaattggacatgggcttgaagaagatggccaagtacctcggtcaagaggtagaaccctttttgccatgtcaaacgagagacgatacctatcaataggacattctcatcttgtggaagggcaaattgtgattgcagggccagtttattagcctttttactttcaatcgtttcaagactataatttctcacaaggtactgatctgtttgactatcccaactgtcatagtcgataccattgacaataccaaccaagtcatatttgcgcaactctagtacatgttgcatgttttcgccgaattcttccgttaggatttcgcgagcataagtttcagaaactgtagtaaccttgtcagcgtataggatacccagcttcatgaagctgatacattcatcatgaaaacgtgcaataccatccaaatagtagctatagtccatgccaagcgctgaccaaagtgcttgtttgtgaaaaataccctgaaaagccaagttatgaatagtgaatacatgcttgatattgcggaattcttcgcggtagctatagaaagtacggcaaaggaatggaagggcagcagtgtgccagtcatgtgtgtgcatgacatccgggaagaaatgaagtgcttctaacagacgacatgtagcatgttggaaatagccaaaacgcatggcatcatcgtcgtatccatatagttcatcgcgttcaaagaaatcgcggtgttcaataaaatagaatgttactccatcaacaacctgactgtaaacatttgccatagattggatgtcgccagcccgcacatcaaaacttgatacgtaatcgaaatcagagtgattgtttactgcaatttttttgtagagtggtagaacgactcggacatctaaaccctgttttaccaattcttttggtaaagagccaataacatcagccaatccgccagtcttgatgaatggaagtccctcggatgctacaaagagaacagatttttttgtcatgttagctcctaaatgatttggtgtggtttcaagtatgaaggcgaagtttcgcttcccttgatgtcaattgggtgaataattttagttgctttatcgataattgcattttcaatattcgccccgctcttgattgtcacgccattgagaatgattgagtttttgataacaacaccttcttcaatgataacatcgcggtcaatgactgaattttcgacttgaccattgatattcgctccatttgaaattaggctacgtttgacctctgccaatggaccatataaacatggtgagctatcacttgtttgagtatggattggccaatcatgtttgaagaggagtttgcgggtatcttggtcaatcaattcaatttgagtattgaagtaggaagctgtcgtattgatacatgcgacataatcacgatgtgcatagcccataatcttgtactggtcaactgtatcacgtaaaatatcttttaaccagtagagagacgacactttgttagcacgtttaatcaagtcgataaatgtagtccgtttcataatgtaggcttcaagggaaacgggacggtttttatatttaccatggttttcctcaagagctacgacacgacggtcttcaccaaatttgagagtttgacaaccgatgaaattttctttagcatctgaaacgtttttataaagaacggtaatatcagcatccgttgcgatatggtcatccatgacttttgaaaaatcctggctatagatgaagtaagatggagcaactagcacataatcttttgtagaattttcgatgtagtggatgttttctgtgaaggcattaatatcgtgacgatagacactatttgggtctgttgcgctattgagcaagcgaagggtaccgcgtttgctgttgatattatagtgtttccctgtaccaacgtgctgaattgttgaacgcatttcggcaggcatgtatacttggaattctgtaattccagagtttgacatattggatagagcaaagtcaattaggcgataacgacctaagaaaccgaaagcttgtacgccacggtgcttcatcacgtcaccaaaatgtacgttgtttccttcaatatttacaattccgagagtatttcttagcatagcagtcctttcttacttggtcacattcttgtcaatcaagaggatatggtcgatgtctcctgtgagtttaactccgtcggcaattttaatattttcagcgacgatgacgtagtcaagttcaacaccttcgccgataatagcaccaggtaggatgacagaattttttactacggcattttggttgacttgcacatctgttgaaataacagaatgttctacagtaccatcgatgattgcccctttatcaatataggcagatttaaccgttgcagttgcaccaatgacttgggcaggagatcccttatcctctgaatagattctccatgagcggtcagaaaggtccaaatctccagcgtgatcaatcaagtccatattggattcccagaggctgttaacggtacctacgtctttccaataaccacggaatggatgggcaatgagagtgcgaccatcttctaagtatttcggaatgatgtcgtgcccaaaatcgtgagatgaagtgtccaatttgtcatcttcttgaaggtactttttcaaggtcttccaagtgaagatatagatacccattgatgctaaattgctcttaggattttctggtttttcttcaaattcttcaatacggtaatcttcgtccgtattcatgataccaaaacgtgaagcttctttgattggaacttcgataaccgcaatcgtggcatctgcttttttctgaatatgtgtatcaaggagtttgtcgtagttcatcttatagatgtggtcaccagacaaaatcaatacgtgctctggatcgtgaagatcaatgaaatcaatgttctgtgtaatagcgtcggctgtacctttgtaaagtccgaaaccttcgattttttcactcggtggtaatacaaagacgccagatccttgtacatcaagtccccaacgttgagactgtgcaacgtatgagttcaagagaacaggctcatactgagtcaaaactccgacaatatcaatacctgagttggcacagttactgagaggaaagtcaataatgcggtactttccgccaaatgcgaccgctggtttggcgactttttttgtcaacccttctagacgtgttccacgtccaccagcaagaatcatagctaacattttattttgagccatctaaccactccttaatatatatgatacatgtattatagcatagagtataaaaaaatgaaagcgtttccttaaagaaaagtgaattattttcatttttcttttcaacgtctttcataaatgtatcataacatattgtattttgtttgtctatataaagtggtatttatttttggtcgaattttacctcttcaagtaggtaattgatgaatttttctcccatgtcggacagcaatgccttttcgtgttgaatatagaccaattcgatttcatcatcaaattccagaggaattgatacaatattatctccgttaaggtttgaattgaggatacctgttgcgattgtatagccatctagaccgattaagagattgaagagtgtggcacggtcagatacgacaatcgattttttatggtgttcctgggctagaatttcttctgcaaagtagaaggagttgtgaataccttgctcatagctgagataggggaaatctaccaaatcatcgagagtgattgactttctttgtgccaaaggattggttttgctgacaaatacatgtggtttggcagtgaagagagttgtataggatagtcgattgtcatccaacagtttcagcagaacatcacggttgaaatggttgaggaaaagcactccgatttctgagcgaaaattcttaacgtcatcaatgatttcccaggtccgtgtttcacgtaggaagagttcataatcttccatttcagtttctttcaaaagtgagacaaaggcgttgacgacaaaggcatagtgttgagaagagacgctaaatagttggcgttttgcattaggatttttatagcgatcttctaaaagctctgtctgttcaacaatttgacgagcgtaggaaagaaactccatgccatcctttgtcagggtaatgcccttagaattacggaaaaagattttaattttcatttctttttccaggtctcgtacagcgttggaaaggctgggttgggtaatgaagagttgtttggcagcctcattcatactgcctgtttctgcaattttgataatatagtataattgttggattctcatacctccattgtaacatgatttgacaaattattctaaaaaatgtataatgctgaaaatatatcctttaactgagtccagagaggcgaagaagggaacgtgataaatagggcaaatactgccttcttttcgtgtaaccttgctagccagcaaggttttttctctatatcgactttcttgttttctgtgtcattgttatatagaataggagaaaagatgattttaaaagaacagatgttactggtggaccaagtccaactagcgccacgaatttttgctatgaccttgcagggtgatatggtccaagatatgaaaatggggcagtttatccatattcgtgtcccagatgattccatgctcttgcggagaccaatatctatttccgagattgatcggaataagtctcaatgtcggattatttaccgagtggaaggtcaagggacggaagtcttttcgaaaatgacggtcgggcagtatttggatgttatgggaccgcttgggaaagagtttgaagtagactttctcaaagaaggtgaccgcattctcatcattggcggaggaatcggtgttcctcccttggtggaagtagccaaacaggctgcgttccgtggtgtcaatgtcacgtcagtcattggctttgccaccaaagaggccgtcattttggaagaggagctggcaagttatgggatggtctatgtcacaacggatgatggttcctatgggcgtaaggggaatgttgcaacggtcgttgaagagctgacaaacgagtttgcagccatttattcctgtggagcacctgctatgatgaactatgttgaccaacgctttcaggaacatcctcatgcctacatttcactggaggctaggatggcttgcgggatgggggcgtgctatgcctgtgttgtcaaacccaaagagggacaagaacacgagaacaagcgtgtctgcaaggaaggtccagtctttgcgacaggtagtctaattttgtaggaggttgaaatgacaaaacgattagcgatttccttaccaggcttggacttgaaaaatcccatcattccagcctctggctgcttcggttttggtcaggaatatgcagattattatgaccttaaccagcttggatctattatgattaaggcgactacccgtcatcctcgttatggcaatgcgactccccgtgtagccgagacaccagcaggtatgctcaatgccattggacttcaaaatccgggtgttgaggcggtcttatccgaaaaattaccatggttagagcaacatttcccagatttgcccatcattgccaatgtggctggtttttccaatgaggaatatgcctatgtgtcagggaaaatttcaaaggctccaaacgtaaaagctatcgagctgaacatttcctgtcccaatgtggaccacggaaataatggtctcttgattggacaggtgccagaattagcctatcaagcagtaaaagcagcagtcgaagcctcatctgtacctgtttacgttaagctgacaccaagtgtggcagacataaccctgttggccaaggctgctgaggctgctggagcgactggcttgacgatgataaataccttggttggtatgcgattcaatctcaaaactcgacaaccaatcttggcaaatggtacaggaggaatgtcaggtccagcagtttttccggttgctctcaaactcattcgtcaggttgctcagatgactgatttaccgattattggtatgggtggtgtggatacggcggacaaggctatagagatgatggttgcaggagcttcagccattggggtagggacagccaactttacagacccatttgcttgtccaaagattattcaagacttgccaaaacgcatggaagtttatggtattgatagtttggaaggtttacgccgagaaatcagatatagcttgggtaagcgttgacaaaggtaaaataaaagagtaatataaagaaaatatctcctttaactaagtccagagaggctaggaaggtgtcatgtaatatgcttgaaaggtgattttcaagctgaattcgtgcacatccctgaccgatttggcagggatttttgtgtaaatgaaaggattttatgaaagaaacaagaccaattattgcccttgactttgcaggtaaagaagaagttcagtcttttctggaacagttcccaccagatgagaaactctatgtaaaggttggaatggagttgtattatgcggagggaccaggtattatcaattatttgaaagactgcggtcacagtatttttctagatttgaaactgcatgatattcctaataccgtcgagtctgctatgaaagtcttggcaaaactcggtgtggatatgaccaacgttcacgctgctggtggtgttgagatgatgcgggcagcacgaaggggattgggtaaggatgctgttttaatagcggtcactcagttgacctctacctcagaagagcagatgaggacggaccagaatatacagactagtttgcaggaagcagttgttcattatgctcaaagagcacaagaagctggtcttgatggggtggtttgttcagctcatgaggtggctttgattaaagatgctacaagttctgattttgtgtgcctgacgccagggattcgtccgactggcggtgaagtaggcgatcagaaacgagttatgacaccagcagatgctgctcgaatcggtagtgattacattgtggtaggtcgcccgattacaaaatcagaacatccttaccagacctatttgtctattaaagaggagtggaatcgtggataagatttatcaggttataatcgatagacctctcgggtatattgataaatttggcaaccagtatccaatcaattacggctatgttccaaatctattggctggagatggtgaagagcaagatgtttacatcatttccaaagctgttcggcagcccttgacagctttcgaggggaaattggtcgcgattatacatcgcagagatgatatcgaggataaatgggttctgacaggtcttgatgaaaaacttaccgtgacagaaataaaagagaaaaccaattttattgaccagtattttgattcatggattgaaatggtggactaggagaagtctgtaagaattcaacagggataaatatagttttttgtagggttcatagattgaaccagtactttaggagtgacaggctattcggcgggatggtcatgttggaatggtacgcatttagaaggaggtctattatgacactagcaacagaaatcgcatcacacttattggatattaaggcagttcatctgcgtctagaaaagccatttacatgggcatcaggtatcaaatcccctatctatacagataatcgtattacactatcttatcctgaaactcgaaatttgattgaagatggctttgtccaacgtattgaagaagaattttctgaggttgaggtgattgccggaactgccacagcaggtattcctcatggtgctatcattgcagatcggatgaatttgccatttgcttatatccgtagcaaaccaaaagatcatggtgcagggaatcaattagagggtcgcatcgtcaagggacaaaaaatggttgtcgttgaagacctgatttctactggagggtctgttctagatgccgtagcagcagctgagcgtgaaggcgctgacgttattggtgttgtggcaatctttacctatgaattgccaaaggcagatcgtaattttgataatgctggcgtgaaattggtgacgcttagcaattattcagagttaatcaaggtcgcaaaagtacagggatatatcaatgcagatggtttgaatctgcttaaaaagttccgtcaaaatcaagaaacttggcaggaagactagatttaaaacgagcccacgcacgatttctgggaacttatcctgtaaaatggtataatagtctctaacgtattttgagaatacaataattgaccgtatgaggagaagaacatgatttcagttatcgtgccttgttttaatgaagaagaggcaattccctatttttacgatgctatggagaaagttcgtaaggagatgggggaacaatttgagtatatttttgtcaatgatggttcaaaggatgggacattaacggttttacgccaattgtctggtcaagaccgagctgttcgctatctttccttttcaaggaatttcgggaaagaagctgctctctatgcaggtctacaagctgcgcaaggtgagctagtgacagtcatggatgttgatttacaagatccacctgaaatgttgatggaaatgaaggctatgttggatggaaatccagatttagattgcgttggaacccgtcgtgtcagtcgtgatggtgaaccaccgattcgtagcttttttgcaaaattattctacaaattgatgaataaaatcagccaggtcgaggtagtagacggtgcccgtgatttccgtctcatgcgtcgtcacatggtagatgccattctatctgtgtctgaatacaatcgcttttcaaaaggaatttttgcttgggtaggattcgaaacagaatacttgccctatgaaaatgttgagagggtcgctggcgaaactagttggtctttctggaaattgctttcttattctattgaaggaatcatcaatttttcagatacacctttgaatattgcctcctatacaggttttttcaccttcctattgtcgctagttctaatggtttttgtggttttcaaaaccttggtgttcggagatcctacaattggctggccgtcgactatttgtatcatcctatttttgggaggtctgcagttgatgaccattggtattctcggtaaatatttggcaaaagttttcttggaaacgaagaaacgtccgatttatattgttaaagagaaaagttcaaactaggagcagtttatggaacattcagcttggcacgaattgataaaggcacagttgccagagcattattttggtaaaattaatcagtttttagatcatgtttatgctggtggaaccatttatccgcctcgtgagaaggtatttgctgccattcaaacaacggatttggaagaggttaaagtagttattttgggacaggatccctatcacggacctggtcaggcacagggcttgtcattttctgttccgaactcggtaccagctccgccatctcttcaaaacattttaaaagaattgacggatgatattggcgtcaaacaagatcatgatttgacagcatgggcggaacaaggtgtgcttttgctcaatgcttgtttaactgttccagcaggtcaggcaaatggacatgcagggcaaatctgggagccttttacggacgctgttattaaggtggtcaatagcttagaccagcctgttgtctatattctttggggtgcttatgctcgcaagaaaaaggcgttgataaccaatccaaaacatctggttatcgaatctgctcatccaagccctctttcagcctatcgaggtttcttcggaagcaagcccttctcacaagcaaatgcctacttgacttcacaaggcagaacaggaattgattggctgcgatagtagatggtaatggctttggtactacaaaggagaatatgaatgttattagtgaaaaatggtcgagtattggatccgcaatccggtttagacaaggtttgcgacatcttgatggacggaagtaagattgttaagattgcggagtcgatttcagaagatgttgagcaagaagtgattgatgcgacaggattagtcgttgctcctggtttggttgatgttcatgtgcattttcgggagccaggtcagacccataaagaagatattcatacaggagctctttctgcagcagcgggtggttttacttctgttgtcatgatggctaacactagtccgacgatttcaaatattgaaaccttaaaagaagtattggattctgctaaaaaagaagccatccatatttatagtgtggcaaccattacagatcatttcgatgggcaaaatctgaccgattttcctgctttgctagaagctggagcggtggccttttcggacgatggtattcctttgacaaatgctggcgtggttagaaaagctatgaaattagccaaagagcagggctgtctcatcagtctgcatgaagaagaccctgacctgaatggtgtcttgggactcaacgagcaagtagctgaaaaacattttcatgtttgtggagcaacaggcgtagcagaatacagtatggtcgctcgcgatgtcatgattgcctatgaaacgggtgcgcgtgttcatatccagcatctatccaaagccgagtcggtcaaggtggttgaatttgttcaaggtctcggagcaaacgtcacggcagaagtagcaccccaacatttttcacgaacagaagaattacttctaacaaaaggtgccaatgctaaaatgaatccgccactacgattagaaagtgatcgcttggctgtgattgatgggttgaaatctggtgttatctctgtcattgcgacggaccatgcacctcatcacccagatgagaaaaatgtagaggaccttacgcaagctccttcaggaatgacaggcttggaaacttcgctttcacttggtttgacgcatctggtggaagaagggcatctgacactcgtacaattgttggagaaaatgaccattaatccagccaagctctatggtcttgatgctggctatcttgctgaaaatggcccagccgatcttgttatttttgacccaaatgcaaatcggttggtcacagcggattttgcctcgaagtctgcaaattctccgtttgttggtgatagtctgaaaggacaggtcctttacaccattgcaaatggacaaatagtatttggtaaataggaaatgagcggattagatagctaattcgcttatttcgaacctttttaacatgtaagcgattttaatgtttttgttttttgataaaaagtgtataatagagatataaaaaatgccgaagaaaggtctatttatgaaaaagaaaaaaatcttgttgcctgtaatgtccacactcttgttggcgccatttgttttagctcaacaagtacaagctgctgagacaacgactgcagctaccacaaccaatcagccagcaacgactgatgcaactgctacggtaccagcaacgactgatgcaactgctacggtaccagcaacgtcagttgaaaacgtagcaacggaggaaactgttgtccctgctgcggaagaaacagtagaggcagtcattatccacacaaacgacgttcacggtcgcattcttgaagaaaagaatgtcatcggtgacgctaaggctgcggcagtcattgaagaagaacgtgccaaagtagaaaatacaattgtagtagatgctggtgatgccttccaaggacttccaatttccaactctacaaaaggtgaagaccgcgccaatatcatgaaccaagtcggctatgatgcaatggctgttggtaaccatgaatttgactttgggatggatcaagcaatcaagtacaaggaaaccttgaacttcccgctattgagtgctaacacttacgttaatggtgctcgtgtttttgaagcttcaactattgtcgataaaactccaactgttgtaggcgatgaatttgtagttatcggtgtaacaacacctgaaactgctacaaaaacccatccgaaaaatgttgagggagtaacatttaccgacccagtcacagaagtcaataaagtgattgacgaagtggaagcgcgcgctctagcagataatcgtgtttacaagaactatatcattctagctcacctaggtgtcgattctacaacgcctgttgaatggagaggttcaactcttgctgaagcactttctaaaaatagtaaattagctggtaaacgtgttattgttatcgacggtcattcccacacggtagaagcgactacctatggagataacgttacttataatcaaacaggctcttacttgaacaatatcggtaaagtaaccttgaaatccgataaattattgggtgaagctagcttgatttctgctgcggatactaaaaatgtgacgccaaatgctaaaatcgcagccttggttgatgaaattaaagcaaaatatgaagctgaaaatgctcaagtagttattgaaaataacccagtggaattaaacggagaccgctcaaacgtgcgtgttcgcgaaaccaacttggggaatgcagtgacggatgcgatctatgcttatggtcaaacaggattttcaaacaaaactagccttgctgtgactaacggtggtggtctacgtgcaacaattgctaaagatcagcctgttacaaaaggtgatattattgcagtcttgccatttggtaacattgtttctcaaatcactgtgactggtcagcaaatttatgatatgtttaccaagtctttatcatctacattgcaagtgaatccagaaactggcgagatgcttttagatgaaaatggcatgccgctctttgaagctagtggtggattcctacacatttcaggagcaaatgtattctacgatccaactcttcctgtagaagaacgtgttcttcttatcggtattcttaatccagagactggcgaatatgacgccttggatcttgaaaaaacgtactatttagcaacaaatgacttccttgctgctggtggtgatggctacacaatgcttggcggagcacgtgaagaaggtccttcaatggacagcgtctttgctgaatacctaaagacagctgacttatcagcttatgaggttgtcaacccatattcacgtatcattcctgtaaattcaagcattgatacggatgaagatggctacccagactttatcgaaattttattggatactgatccagaaaatccagcctcaaatccagaaactgttccagccgaaaatacggattcaccatctaatcaagtacaaaatacttcagcaacggacaagaaggccccagttgattctccgaaagtaggagataaaaaaacagaagtagcaagtccagcaaaaactacaaaagcaggagtcttgccaaatactggtgatcagatgaatctgacgctcagcctgtttggtttaggtcttgcaggactggccgtggcagtaggtcgtagaaaagaaaattaatcaatcatctgaaaacagggtcttcggactctgtttttgactggaggaaacatgcaaactgtatttcaatatcaaaaagagggggattgtgagcagattagttcttacgttctgcttagcaactccccacgtcgtaaacaattattgggatttttacaaccacaaatcgcatcagttgaagtggatgagcgtggtatcgaagaacattttatgaaacaattcgctacagatgattttctcactcgagctgcaaaaacctgttgtgaaatttccaaagccaaatcggacatggatttggtaactggtcatctctacatttctgcggatacaatcgtagtgtcagatgggcaaatttttaacaagcctcaagatttgacagaagctgaaaccatgttacgttcctattttggaaagagtcatcacgttgttacatctgtctgcctacggacaagacactcactggatgttttttatacggttgcacagattgattttgtcgactattatccagcccttgaagaggttattcaatcatatatccgtgaaaagcagccactcgacaaggcaggtgcctatggtattcaggagctggatccacgctttgtagcaggtatttctggggatattcacaccattattggtctacctgtagcagaagtttcctgcaggattttttctgaagaaggttttgaaaattagcagagcttaaccattcgtttgtggtataatagtggacgaaaaggagagattatgaccgtcgacattgaaagatacaagcaattggcccagcagaagcaaggagaacatcgaaaatttctagcaaatttgaagaagaaaacacctaaaaatttggatagaattgttcaagatattcatgccgaagtattttctgaaatcgactgtacagagtgtgccaactgttgtaaaacattgggaccactctttacagaagcagatattacccgaattgccaagcatttgcgcatgaaacttccagtttttgaggatatgtatttgcgtatggatgaggacggagataaggtatttcaatccatgccctgtcccttccttggaggcgataatctatgtagtatctatgatgctcgtcccaaagcctgtcgagaatttccacatactgaccgcaagaagatttatcaaatcaacaatttaacaataaaaaatactctgatttgtcccgcagcctatctctttgtcgaaaagttacgggagagaatttaagaggaacaagtaagacaaaatattgattttctgctataataataaaaaaacaagccgtttttacggcttttttcaatgaatcatatttaggaggaccccatggcaattattcaatggtttccgggccacatgtcaaaagctcgcaggcaggtgcaggagaacatcaagcacgttgatttcgtgaccattttggtcgatgcccgtctgcccctatccagccaaaaccccatgttgaccaagattgtcggagacaagcccaagctcatgattctcaacaaggtcgacttagcagaccctgttcgtaccaaagaatggcagagctactttgaaggtcaaggcatccgtacccttgccatcaactcaaaagagcaagcgacggtgaaaaaggtgaccgacgcagccaagggtctgatgaaagacaagattgaacgcctccgcgagagaggtattcaaaaagaaaccttgcggaccatgatcatcggtattccaaacgctggaaaatccaccctcatgaaccgtctggctggtaagaaaatcgccgttgttggcaacaaaccaggtgtgacgaagggccaacagtggctcaaatccaacaaggaccttgaaatccttgatacacctgggatactctggcctaaatttgaggaccaggaagttggacttaagttggctctgacaggagccattaaggatcagctcttgcctatggatgaagtgactatttttggtttggactacttcaaagccaactacccagaacgtctacaagagcgatttaaggggatggatttggagcaggaaacacctgaactcatcatggactggaccaagaaattgggctttcgtgatgattatgaccgtttttacaacctctttgtcaaggacgttcgggacggtcgcttgggtacttatacattagacagggtgagtgacttagatggcaacgattaaggaagtgacagctctgctggcccaggtagacagtctggacagtccagtctgggaccaactggctcaggatgagcgagcaggggtccaggctgctatcaagaaacgccgtaaggagctggaaaaagaagcggtagaagatgcccgcttagaagctatgctattctacgaaaaatccctttatgaaaatggggtggagttcatcgctggtatcgacgaagtcggccggggacctctagcaggtcctgtggtggcagcggcggttatcttgcctaaagggtgcaaaatccgctacctcaacgactccaagaaaatccccaagtccaagcatgaagcaatctaccaagaggttatggagcgagcggtggcagtcggtgtgggaataaaagatgcagctctcatcgacgaggtcaacatctatgaggcaaccaagttagccatgctggaggctttggggaaattaagccagaaacctgaccacttgctcatagacgccatgaagttggatacgcccataccacaaacttccatcatcaagggagatgccaatagcctatctatcgcagcggcctctattgtagccaaggtgacgcgggataagatgatggcggactatgacaaggagttctcaggctacggcttcgccaagaatgctggctatggaacgacagagcacttggaaggcttgaacaagttaggcatcacgcccattcaccgtaagacctttgagcccattaagtctatggtagcagggggaaactagtcttgacagtctttttctggttatttttagcggctatcggtctgtttgctcttgtctatttctgggagcggcggtcgatttttatctcactgtttgctttgaacatcctcgtctgggctttagcatggattatctcaacaggcattctcgaatacaatgaaatcttgcgcttgctggctatagcagtggctatggtgctctttttagccttgttaagtggtccatttgtcttgcttttcacactttatctaaatggttttcaaattttgaagagagaaggggttcgcttccataatttcctatccatgggactggcggtagccttgactttctatctcttcatcgctccctttgtggttcaatctctatcagccatcagctttttcaatatggtgtttgtgtacgttggtttttttgtgtcctatgccattatcatcagcatgctctataccatgtctagctttgtcaatttggtcaattttttcccaggcaagcttgattatgtagtggtcttgggagcaggtctgattggtgacaaggtaacgccacttttggcttcgcggattgaaaaaggcatagcgatctaccagaaacagcctggcagcaagctcatcatgtcaggcggacaaggtcctgatgaactcatagcagaaggacaggcaatggcaaattatgccttggagaaaggagtgcctgctgaagacattctcatcgaaaaccaatcaaccaacacagaagaaaatttgaaattttcctatgccctgatgaaacctggcagtcgatttgcacttgtaaccaattactatcacgttttcagagctctgctattggcacgacaattgagaatcaaatgtatcggctacggcgcaaaaaccaaattttactttagccttaatgccttcattcgggaatttgtaggctatgtagtcatgagccgaaaggcgcatttggtctttttgagcatcgtgtcagccctttacttgattggagtgatcatcagtttaatgcattaaaaacagcctctaggtgactagaagctgttttcttataacataaagtagacaatggcgatatactgaagtgccgaagccagtaggataaagagatgccaaatcatgtggaagtagggctttttcttggcatagaagagggctccaatagtataagataatccaccagccagcatgagaatgccaaatgccattccagtcttttgcagaatggctggcaggataaagaccaccaaccagcccataaagagatagaggaaaaggctgaatttttcattgatttttttggcaaatattttgtagagaataccaaaaatagttaatccccattgtaaacctacaatcagataacctagccaaccaccgaccaaggaaagggcaacaggtgtgtagcttccagcgatggcaatgtaaatcatgctatggtcaataatcctcaggatgtatttgtgagtagaagcatagggcatggagtggtagatggaagaggataggaacatgagaaataggctgatgacaaagatggacataccaatcacagcggtcaggttataatcttgataggaatgaatagcagtaacggggagcaagaccaacataagcagggctccgactgcatgtgtgacactgttagcaacctcctctccaaaggatagttgcaggctcaatttcaaactaggattcatggtgactcctttctaactccatagtgagttgacgggttttgtagtaaagtttgacagattgacaagcgtagcgaatgatgtcaggggtttcttcattttcctcgtttcgcatgcagtcaacaaaatgattgtagagtgtttctgaatgactcgattggagaagaagatttaaggtctgactgatttcttgaatcgaaaagacattttttaagatagtcaaggcaatcaagcgggcaacttgctgtttctggtattttttctttaccggtttttcaagttgcttgtgcttgacataattgttaatcatagcagcagtcaatactcttcgaaaatcaacattatccgttatcaacttgccttgatgaaccccagttctatcatcagcttcgtttcctaggctactgttgattttcattgagtataaactcttctgttcaaggctttcctgagaattgactacttgattaacatacagcagaacttggtccaaatacaaatctaaatcaggtaattcatgccagtagggaatggtctgtttcatgattatctactctcttttatctagtaatgataactagattgtacgatatacaatatttaatgtcaagaaaaaaccttctggacccaaaatcacagaaggttagttgcttatggttggataatatttttaggcaatgtcatcttataaagtgaataggctccatctaggtttttaactataaaaccattttcttttaagatacgttcggcaatataagaacgcagtccactatggcagctgacaatgtattcttttgaagcatccagttctccaattcgctcacggagttggtccaaaggaatgtgaatgaattctctgaattgcccatttgcgacctcaccaggattgcggacatctaatagaactttaccagtagctaactcgtcgtctagttgataccactggatgttttggctaatcccttctgcgatgttcatagcagcgtagccaatcatattgacagggtctttggcagagccaaatggcggagcgtaagtcaattctagctctggtaaatcaaaaattgtcagtccagccttgatagcagtggcaaggacatcaatccgcttatcaatacctttttgaccgacggcttgcgctccgaaaatttttccatcagtcggtgagaaaatgagttttaaaacaatatcagtcgcaccaggataataacctgcatggtcttttccagttgtatgaacgacggcatgtttatagccgagtgattgaacagcacgttcgcttaaaccagttgaagcggcagctaggtcaaagacttttacgatagctgttccaatagatcctttgttttttctatcaagtccagcaatgacatcagctacctgtcttccctgacggttagcaggagaagccagtgaaatcaaggcatcttgacctgtaatttcttgtttaacaacaatagcatcaccaacagcataaatattcttctgactagtttggtagttttggtctacgagaataccaccacggagacctaactcaactccagcatctttggctagttgactgtcgggagcaactccgactgagagaatggtcacatcagatgacaaggtttgtccgttagacaattctagaacctgtcctttttcatgaaaagcagtaacagactgcccagtgataacctcgacacctttattggttagctctgcttccacatatcgtgccatttctaagtcaaaagtaggtaaaacatggggagcttgttcgacaagcatgaccttccagccttttaaagctaagttttccgccatttccagaccgataaaacctgcaccaattaccacaacatgaccagacttgatctggtctagtttaatcataatcttgtccaaatcaggtacgttccgaagagtaaagagattgtttgcttcttcaataccagatagatttggaatgacaggcttggcgccgggtgataagattagtttgtcgtagctttcaatcaactcaccagtaggcgttttgactgttacagtttgctgctcagcatcgatactaatgacttcatggaaggggcggacatctagattaaagcgttgtttcaaactttctggcgtttgaagcaataaactgtcatgctctgctatttctccagaaatgtaataaggtaaaccgcagttggcaaaggaaacataaggtcctttctcaaaaacgatgatttcagcattttccatcaaacgacggagacgagtagctgctgacataccgccagcgacaccacctacaataattattttcatgctattcctcctgtccaggcattcataccgcctttaacgttgattgcttgatagccttgagatttaagatattctgtcgcccgttggctacgcatgccagattgacagatgacaagatagttcttggttttgtcgcctttaaattggtcaagttgacttaagggctggttgatagcttgtggaatatgtccactagcaaattcgtcgacttcgcgaacatcaagcaaaatagcattcgatgattgtatcgcttgttctacatcagttatcggaagactatctgagtttgaaaacattcctgaaaataattgtttaaacattgttactcctttataccctacagggtatctaaaatatatcaaggaattcgaaagatgtcaaggtaaaaaattgacatttttcacttcaagcagtaccatatagggtatgaatactgataagaaaaagatgataaaccgtttgaaacgggccgaaggtcagctcagaggcattcagaaaatgattgaagaagatcaggaatgtattgatattgtaactcagttgagtgctgttcgttccagcattaatagtatgatgggaatggttattgctcagaaggtacaagattgtatcactcatccatctgaaaaccctgaagaacaagaagctcgtcttgctcaagctatcaatttaatcataaaaaaataggagtaggggtatgtcgacagaaaaagaaaagatgatagctgggcaattttatatggcagcagatgctgaattgagaaagatgcgaacctttgcccgccaacagatgaaaaaatttaacgaagaactagatggaaaagcccgctctgagcgattgaaaagctggtttggaactacaggccaacgcatctatatggagcccaatttctactgtgactacgatagcaatattcatgttggtgaggatttttacgctaatttcaactgtaccatgttggatgtctgtcccattaccattggcaaaaatgccatgcttggtcccaatgtacagttgctaactccacttcatccactagatcctgatgaacgaaattctggtttggaatatggctctcctattaccattggtgataatttctgggctggtggtggtgtgacaatcttacctggcgtgaccttgggcaacaatgttgttggtggtgctggttccgttgtgaccaagtcttttggtgataatgtcgttttggctggcaatcctgcgcgtgttatcaaagaaatacctaaaaaataattcttcttcgggagaattttttctttgccttgcgaatagactagatgaggtgaagaaaatgaataattttgaattgtttaaatggaaaaaagcaggtttgaccaatcttaatgtgaataaagttttggcctatcaagaaaaacacggtaaaaaattgaccttgcgaaatgtcgctgtagtgtctgaatgtaaaaatccagtgctatttatggaaaattataagaatctagatacaaaagcctgtcgcgaggaatttaataagtatccatcattttcaattttagatgacatctatcctttggcgctcaaacagatttacaatccacctgtacttttgttttatcaaggggatttagaattgctagaaaaattaaagctggcagttgttggtacacgaaatgccagtaaaaatggtatccaatctgttcagaaaattatcaaggaattgagcaatcgttttgtcattgttagtggtttggcaagaggaattgatacagctgcccacatcgccagtttgaaaaatggaggccaaaccattgctgtaatcggaacaggtttagataatatttatccaaaagaaaataaagatttgcagacctatattggaaaacaccatttggtgctgacagagtatgaagctggtgctcagccactcaaataccattttccagaacgcaatcgcattatagctggtttggtggaaggattggtagtctgcgaggcaaaaatgcggtctggcagcttgattacttgtgaacgtgccttggaagaaggaagagaagtctatgctattccaggttccattatggacggaaaatcagatggttgtcatcatttgattcaagagggagcaaagtgcgttacatcaggattggacatcatttctgagtatcaattttaaaacaagtcttcctataggaaaataaatatcttgacactgactgaaaaatagtatattctttgtgaggttaaaaatatttgtaaggtataagaatggctacaaaaacagttagtaagaaaaaaacaacaaccaagaaaaatctcgttattgtagagtcacctgctaaggcaaaaacaatcgaaaaatatcttggtaaaaattataaggtcgttgcttcagtcgggcatattcgagatttgaagaaatctagtatgtctattgactttgataacaactatgcacctgagtacatcaacatacgtggaaaaggaccactcatcaattctttgaaaaaagaagcaaaaaatgctaagcaagtctttctcgcgagtgacccggaccgcgaaggagaagcaatttcttggcatttggctcacattttgggattggacgcaaacgataaaaaccgtgttgtctttaatgaaattacaaaagatgcagtaaaaaatgcttttcaggagccgcgcgctatcaatcatgacttggtagatgcccagcaagctcgtcgcgtcttagaccgtattgtagggtactccatatcacctattttatggaagaaagtcaaaaaaggtctgtcagcaggacgtgttcaatcggttgctctcaaattaataatcgaccgtgaaaatgaaatcagcaatttcaaaccagaagaatattggacaattgatgcaaccttcaaaaaggggagcaagaaattccaggcttctttctacggtatagatggaaagaaaactaaaattgaaaacaatgagcaggttaaagaaattctcgcccgacttgatggggatgatttcttagtagaacaggttgagcgtaaggaacgcaaacgaaatgcacctctgccttacacaacttctactatgcagatggatgcggctaataaaatcaatttccgtactcgtaaaaccatgatggttgcccaacaactttatgagggtgtcagtcttggcacaggtggtacccaaggtttgattacctatatgcgtacggattcaacacgtattagccctgttgcacaagcacaagctgctgactttatcacggagcgttttggtgctacctattcaaagcatggtaataaagtaaaaaatgccagtggtgcacaagatgcccacgaagccattcgtccatcaaatgttaacttaacacctgaatcaattgcaaaatatctggacaaggaccagttgcgactatatacactgatttggaatcgttttgtcgcaagtcagatggctgcagcggtctttgataccatgagtgttcgtctaggtcaaaatggagtgatttttgctgccaatggtagccaagttaaatttgatggttacatggcagtctataatgattctgacaagaataagatgttgccagatatggagcaaggtgatacagttgtacgtacatcaacaaatcctgaacaacattttacgcagccaccagctcgctattctgaagctactttgattaagactttggaagaaaatggtgttggtcgtccgtcaacctatgcaccaaccattgaaaccattcagaaacgctactatgttaagttagctgctaagcgatttgaaccgactgaactcggcgaaatcgttaataagctgattgttgaattcttcccagatattgtcaatgtcaaatttacagccgatatggaacaaaaattggatgatgtagaaatcgggaaagagcagtggcagaaggtcattgatggtttctatcagccattcaaggtagaattatctaaggcagaagaacagatggaaaaaatccaaattaaggatgaaccagctggctttgactgtgatgtttgtggacatgaaatggtcattaaactaggtcgttttggaaaattctatgcttgtagtaatttccccgattgccgcaataccaagcaaattaccaaggagatcggcgtaacttgccccgtgtgtcaacaaggccaggtcattgaacgaaagagcaaacgcaatcgacttttctatggttgtgaccgttatccagagtgtgaatttacctcatgggataaacctgttggtcgtgcctgtccaaaatgtgaccactatcttgtcgagaaaaaagttcgtggtggtggtaaacaagttgtctgtccaaatggtgactacgaagaagacaagattaaataagattaaactgctattctcaagggaatggcagttgttttttatagtcatgttagtttatcttagcttacttcgacaagcgaggaaacttcgtttccttattttcaactttaaatgaggctggtcaaaaagtccaaagtcacttctcagtgcagtggttgattgggtttaacaggccagtggagtgaaactgttcagtgaactgtttcagcctgagcttagaaatgaaaaaatcgaggtaaaaaggttggagataagatttgcgaagcaaatcacagcaattcgtgtttcacattccaagtctgacctctacaactaaaacgaactaaacggcaataccagtttgaaaaattgtttaaaaaattaaaaaaataggagaaaagtcttgcattattgaaaatactgtgttatgataattgaggtttgaaaaaactgacctaagacagtaggggagctggactcataaacatcctaccgaggcacaaaacgattattgagataaacgtatttgtactttcgtgtctaggtttaggtgcgatttttttgtgcctagcccaaaataaaaacggaggtaaaaaaatgagtgaagctattatcgctaaaaaagcggaattagtaaatgccgttgctgagcaaatgaaagctgcaacatctatcgttgttgtagacgctcgtggtttgacagtagaacaagatacagttcttcgtcgtaacttgcgtggtgcagaagttgagtacaaagttatcaaaaactcaatcttgcgtcgtgctgctgagcaagctggtcttgaaggtcttgcagaattgtttgtaggtccatctgcagttgcattctcaaacgatgcagttgctccagctaaaacaatttacgatttcgcgaaaactgctgatgctcttgaaatcaaaggtggtgctgtagaaggtaaagtttcttctaaagaagaaatcgaagcacttgctacattgccaaaccgagaaggcatgctttctatgttgctttctgtacttcaagcgccagttcgcaacgttgcatacgctgtcaaagctgttgcagaaaaagaagacgctgcttaatgcgtcagagcgtagctgcttagtgctacaaactatttaaaaacctaaattggaggaaaatcacaatggcattgaacattgaaaacattattgctgaaattaaagaagctactatccttgagcttaacgaccttgttaaagctatcgaagaagaatttggtgtaactgcggctgctcctgtagctgttgctgcagctggtggtgctgctgaagaagctaaagattcattcgacgttgaattgacatctgctggcgacaaaaaagttggcgttatcaaagttgtacgtgaaatcactggtcttggtcttaaagaagctaaagagcttgttgacggtgcaccagctatggttaaagaaggcgttgcaactgcagaagctgaagaaatcaaagctaaattggaagaagcaggcgcttcagttactcttaaataagagtcacatcataattagattgcggaatccctatttaccagtctttgagagcgataagcgattgatagaaactgataaattgatttggtttcctgccaaaaatcctgccaaaaattctttggcaggatttttgttttaataaattttcggggtagacattaaattgtctgcccctttttttgcgttttggaggtaattatgcaaaagaaggaacaatcatcacgccaaatcgtgatgtgtcatctcgtggctattttaggagttgatattgagaaagcaacacagctaattgatgaaatggaacaactaggtttaatccgatttgatgaatttggaaatgttggaatattagtcttggagggacaatcatgaaacgtattaccgctaatcaatatcaaacatcagagcgttattataaactccctaaaattttgtttgagagtgaacgttataaggatatgaagctggaggttaaggtagcctacgcggttttaaaagatcggttggagttgtctttgagtaaaggttggattgatgaggatggggctatttatttgatttattccaattcaaatctgatggcacttttaggctgttcaaagtcaaaactactctctatcaagaaaatattacgcgaatatggcttaatcgatgaagtccaacagtcctctagtgaaagaggtcgaatggcaaataaaatttacttgggggaattagaacatgaaactaccccagtcttacatacagacggggctagtgttaaaaaaacactaggggggtctcaaagaaagacggggccggtcttatattcagcccctagtgagactgaaggaagtgaaactgaatatagtgaaactgaagggagtgatttccttattgaggacgaggaggagaggcagctagtagatgagaaacaagaagagaactttacttcaaaagttgatggagtgaccaagtatgatcgagactatatttggggtttggttcatgaccagttaagacagacaagtttatctcagtcggctagtgactatgccatgctctattttagtgaccgttatcagtatgcattggaacatatgcgatttgctcggtcagcggaagtaatagctgaatacgtatttaatggtgtgctatcagagtggaccaagcaactgagacgacaagaagtaaagggaggtgattaagttgatttggtggatactaggtggaatctatctgatttctatcgtcattttgatttttgaaatcatccgtgcaccagaaatggatgatcatatataagcaagagttttacaagtgtaaggctcttttttagttggaaagagaggaaagatgaaatttttagatttatttgctgggataggcggttttaggctagggatggaatcacagggtcataaatgcctgggcttctgtgaaattgataaattcgccagaacatcttataaagccatgtttaacacagaaggggaaatagaataccatgacattaaagaggtcacagaccatgactttagacaatttagagggcaagtggacatcatctgcgggggatttccttgccaagcattttcactcgcaggcagacgattgggatttgaagatactcgagggactctcttttttgagattgctcgagcggccaaacaaatccaaccacgttttctatttttggaaaacgtcaaaggcctactcaatcacgacgagggacggacgttcgccacaatcctctccacgttggatgaattggggtatgatgtcgaatggcaggtgcttaacagtaaggacttccaagtcccgcaaaacagagagcgggtctttattatcggacattctagaagataccgtcccagattcttatttcctctcagaagagaaaacagcccagctcatcttgaaaggttaggaaatatcaatccctctaaacgtggtttgaatggtgaagtctatctgacgaatggacttgctcctacacttacaagaggtaaaggagagggagctaaaatcgccattccagtcttaacaccagatagactagaaaaacggcaacatggtcgtcgacttaaggacaatcaagaccctatgtttactttgactagtcaagacagacacggggttgttgtcgcaggaaatctgccgactagctttgaccagactggaagagtatttgacatatctggcttgtcaccgactttgaccaccatgcagggtggagataaagtgccaaagattttactgagggaggaactgccatttctgaaaatcaaggaagccacaaaaacaggctacgcaaaggcaactcttggagactctgtcaatctggcttatccagactcaaccaaacgtaggggacgtgtgggaaagggaatatccaatactctgacgacttcagacaatatgggagtggtggttgctgctctggaatatcgacaggataagtggtatgaagtcacaggcattgtcttagaggggaaactttatcgcctgagaataagacgactgacaccaagagagtgtttcagacttcaaggctttcctgattgggcttttgacaaagcagaaagtgtttccagtaagagccaactatacaaacaggccggcaatagcgtgactgtcacagttattgaagccattgccagtgaatttagaagaacggaagaggaagaaaaacatgaacctactacataagaaaagtatcctagattgtactgaattagaagaacatattcaccaagttgaaaccaatcagttattacaaaagatactgtcgctccccaattttgattgtgactttgaggtgacttttgaagatgattaccacaaagagatgaatgatcccctattctacgaatccaatcttcatcggatttcggattttatggaaactagggatattaaaaatggtgtagatactctcttgacgaaagacaatcacctggcctttcgtgcctttggtgaaaattattctgctagaggaaaggatggcattttaacgactttagtgacggtcaagtgctttggtgaaggacggatgcccattgatatgagtcgctatttctcaactcctgaaccaacagttgaaaatagcctaaccctataaggaggtgcctatgcttgaggtatatctaggaaataatgtcaatacaaatcaagacttactaaccattttgaccaactatggggtgacttatcgttgtacaaaagcgtgtgatgtaaaccgtgaaatcttactgtcactctttgccaaaaccacggattgttttgagttgctgtcgccacgatttcttcgctttaaacgtcaatattcgataagtttgaatgagatgattcagctcattctccaaaagccagaccaaaaccttcgtctgcctctcattgtctgtcagaatcacgtctatccagctattggattagacgaagtgcgtacttttcttcccagacaagtaaaagaagagctgtttcaggccagtctgatgaaacaggtgacagggtaggtgtgaagatgaatgaacgattttgggacaatttagagattattctggcagaaaaagacctcacttgggcagaactagctcgcaaagtattcaacggtcaatatgtttatccaagtgagtttaatcgtctctatcaaaaactgcgacattacaaatccaatcgtctgatgccccagacaagatgggttgagcgaatcgttctagtcttagatattgattatgaagatttattcaagaggtgataatgataaggatagtgttgttttatctagccatacagcttaacggtcttctggtgagtttatacctacaagactatgtgacgattaaggtcttagtcttgctacaattggtcctattaagtgtgacttgcttagagattgcccgtcataaaactgttcaagcaaaaaatataaccttaagaaatcgcctaagatggttgcttcttggttttgtgtctatggttgcttttgcagtcttcatcagctttctattttcagttcagactaggaatcaagcggtcttgttacaagtaggaaaacaagttccacatgttatctttttattgtttctggtcaatgcaagtctccttgaagagattgtttataggcaattgctgtgggaaaaattgacattcccttttgtacaaataggcgtgaccagttttctctttgttctatcccatggccccaatcagttagggagttggctcatgtatagctgtcttggcttgaccttggctgctgttcgattgaaaactgattgtatgacggcaatcatcttacatttactttggaatagtttggcttatgtcgtaactttcttgtgataccaaaatcaagagtgtttccgtattatggaaacaccttatgtttgagagggaatcgaaaaaaagaggaggtcaccatgtcatctgaacaacaagaacgtcaagcgatgcaatacgtggaaagaagtagtttattgacagtcagaaccctcttaaagctcttagaatggtcggctaggcaagccttagctcaagattcagcttataagattggggttcaaaaactggaagaactccttcaaagcccttatgcaattgaagcgatagatgttagtaaagacatactggataagccaatcgatgtggagaaatttaaggagttgatggagtcagaaaaactgccaatcgcaattagttggcaaaaagactatctctacttttatgccaaggataagaccttgctcgatcattacttggatgaattgttgaagaaactgatgtctaatccagagaaactagaaggtttaacttttgataaaaccttggaccaagagatagaactggccaaagaaagaataagagtgacagaaccttcggcagtcaaaaccaaggaggtgaccttgtaatgtattcaagacgaaaagcatttgtctttggtctcttgggtctcgcctttggctatttctgccatcgtctaactctactctatgatagtttaaccaatgccccacctatggaacgatttgcctacctcttaggagaggggttaaatcaggttttcaatcctttatggctttttgcttttactcaaaaatctcttcttgcctttatccttggggttctaacgatgacactagtctatctttatgtatcgacaggacagaaggtctatcgagaaggggaagaatacggttctgcacgatttggaaccagtaaggaaaagcggaacttttacagtaagaatcctttcaatgacacgattttggctcgtgatgttcgtctaaccttgttggaaaagaagaagcccctgtttgaccgaaataaaaacttgattgttattgggggttctggggcaggcaagacctttcgatttgttaaacccaatcttatccaacttaattgttccaatattgtcgtagatcctaaagaccatttggctgagaagacaggtaaactctttttggaaaatggttatcaggtcaaggttttagacttggttaatatgaccaattcagacggttttaatccctttcgttatgtagaaacagagaatgatttgaaccgcatgttaacggtctattttaacaatacccgtgggtctggttctcgcagtgatccattttgggacgaggcttccatgacattggtgagagctattgcctcttatttggtggatttttacaatcctccaggaagttccaagcaagagcaggaagcaagacgtaagcgtggccgttatccagccttttctgagattgggaaactcatcaaactcttatcaaagggagacaatcaggacaaaagtgttcttgaagtcctgtttgaagactatgctaagaaatatggtcatgagaactttaccatgagaaactgggcggattttcagaactacaaggacaagaccttggattcggtcattgctgtgacgaccgctaagtttgcactctttaatatccaatcagtgattgatttgacgcaaagagacactatggatttgaaaacgtggggcactcaaaagaccatggtctatcttgttattccagacaatgatacgacctttcgtttcctatctgctttatttttttctacagttttctccactttgaccagacaggctgatgttgactttaaagggcaactgccgattcatgttagaagctatctggatgagtttgcgaatgtcggagaaatcccagactttgccgaacaaacctcaacagttcgctctagaaacatgagtctagttccaatcttgcaaaatattgctcaactccaaggactttataaggaaaaagaggcttggaaaactatactggggaactgtgacagcctcctctatttgggtggaaatgacgaggaaacattcaaatttatgagtggtcttctaggtaaacaaaccattgatgtcagaagtaccagtcattcttttgggcagactggctcaagttctacctctcaccagaaaattgctcgtgacttgatgacggctgatgaagtcggaaatatgaaacgagatgagtgtcttgtacgcattgcaggggttcctgtttttcgaaccaagaaatattttccgctcaaacataagaattggaaatggcttgcggataaggaaaccgatgaacgctggtggcactatcatatcaatcccctaaccgctgaggaagaggtagatttgtcaggccataaaataagagatttaagcacagaaacgacactacattaatagaaatgaggaattatatgaatcaaaaactaacaggctttgtttacggagtggacgccagctccatgttctcccaagcaatgtctctattacaaaaaggcttaattgcagtaggagcctttcttgttgtcatgggcattatcaacctttcaaccaatattaaagatggtggaccaggtgtccgaaatgctattctagaaattgttggtggggtcatggtgggagccgctggtgcttttgtgactcagattaccatttaggggaggactgcacatgacatgatgatgaattttacgtcaccttttgtatatttagcctctgaaaaagtatctagcgatagcctttttgaagggtttcaagtggatttagaatcgaccgccaacttggttaagtcactagcggactttaatccgacggtttggtcttacatgacagccattaccaagggaattatgcagcccttgggagtagctattcttgcggttgttctcgtactcgaattttcaaaaatggccaagaaaatcgcaaactcaggtggtgcaatgaccttcgaagccatggcacctatgattgtcagctacatcatggtcgcggtcgtgattaccaatacgacggttattgtggaagccattattgcccttgcctcttatgttattgaacaagtggcaggtcttgtcacgaatggtggtactaattacgataccatctcaggcatcaagggatctgggattgtaggaaaaatgattattggcttttttgcgattctcatttggttggtacgaatggccagtatcatggttgtcaatatcttgattaccattcgctttatccaactctatctgatgattccttttgcccctgttaccattccgaccttccttagtgatgactggagaagtgttgggattggttaccttaaaaacattatggtctatgccgttcagggtattttgatttttctaattgtatctcttgttcccttgtttgaatcggctggaaagattgccgtatcaaatggagctggagtgatggaatcactcgccattatgtttggtggcttggtacaggccatattgttaatcattgccttagttggcagtcaacgaaccgcccgaagtattttggggatgtaggaggatgggagtaaattgcccgcctcctctttttatagcttatttagattggagaacatttatgaacacacgtgtctttaaggacatctcaaaggttcaacacagggcatggctgggatttacaactagacaggttatttttgtatttccagccgtcgccataaccattttggtattgggcttgaacctattttactggcaatttggggattggtttgtctatggttttgtttttagctttaccattccactcatgttatttggggtctatcgccctaatgatttaccatttgaaatctacctcaagtaccgttttcattatgaactaacggtgccagaccgcacatttactggaagaaaaggagaccaacgtgaaaaaattaaaacactcaatgaaaccaaagacctcttctaatgacaaaaagcaaaagacgaaaacacagaagcaggagatcagaccttctaccgtaaatacgttagcctatcaagggctttttcagaatggccttatgcagatcagtccaagttatttctcacaaacctatctcttaggagatgtcaattatcaaacagttggcttagatgataagggagctatcgtggagaaatattccgatttaatcaattcactggatgatcagaccaatttccaactgaccattttcaatcaaaaagttaatttggaaaaattccgtaagagtattctctatcccttgcaggaagatgggtttgatgcttatcgtgatgaattgaatcgcatgatggatgccaacttagaggcgggtgagaacaacttttcagccgtcaagtttctttcatttggcaagagcgaccaaacaccaaaagtagcttttcgttctctgtcacagattggggaatatttcaagagtggcttttcagagattgatgtggctcttggtttacttggtggagaggagcgagtgaatgtccttgcggatatgttgcgaggtgaaaatcatttaccgttctcttacaaggatttgaccctctcaggtcaaactaccaaacactttattgccccaacctacctttcctttaaacacaagaatcatattgaattggacgatcgattattacagattgtctatgttcgtgattacggtatggagctaggggataaatttattcgtgacctcatgcagtcagatttggaagtgatgattagcctacatgctaaaggctctaccaagtctgaaaccatgaccaagctacgaaccaagaagaccttgatggaatcgcaaaagattggggaacaacaaaagatggctcggactggaatctatttggagaaggtcggccatgttcttgagaacaacatcaatgaagcagaagctcttcttcaaaccatgacccagacaggagataaactgtttgacaccgtatttctaattggcgtgcttgcggatactgaagaccaactcaaacaatctcttgatattatcaagcaagtggcagggtctaatgatatgattattgataatttgacctatatgcaagaagctgcttttaatagtctcttgccatttgggaagaactatctcgaaggtgtttctcggtctctattgacttcaaacattgccgtgaatgccccttggacttccgtagatattcaggacaagggtgggaaattttatggtatcaatcaaatctcaagtaatatcatcagtattgaccgtggcaagttaaatactccgtcaggtttgattttagggacttctggagctggcaaagggatggcgacaaaacatgaaatcatctctactaagctcaaggaagcagataatgatactgaaattattattgtcgacccagaaaatgagtacagtattatcggtcaagcctttggtggggagagtattgatattgccccagattccactaccttcttaaatgtcttagacctatccgatgagaatatggatgaggatccggtcaaggtcaagtccgaatttctcttgtcctggattggaaagctcttggaccgtaaaatggatggtcgtgaaaagtctctaattgaccgtgtgacgagacttacctataagcattttgacacaccatcattggtcgaatgggtctttgtcttatcccaacaacctgaacaggaagctaaggacttggcactggatatggaactctatgtggaagggtcgctggacatattttcacatcggaccaatattaaaacagacagtcatttcctgatttacaatgtcaaaaagttaggcgatgaattaaaacagattgccctcatggttatctttgaccagatttggaatcgtgtggtaaaaaaccaaaaactagggaagaaaacctggatttactttgatgaaatgcagctacttttattggacaagtatgcctctgattttttctttaaactctggagtcgtgtccgtaagtatggggcgataccgacaggcattacccagaatgtagaaacacttcttttggatgccaatggtagacgcattattgccaatagcgagtttatgattcttttaaaacaggctaagagcgatcgcgaagaattggtgcatatgcttggactttccaaggaacttgagaaatacttggtcaatcctgaaaaaggggctggcttaattaaagccggttccaccgttgtcccgtttaagaataagatttcacaacacaccaagctctttgacatcatgagtacggaccctaaaaaaatgaggatatgagatgaaagaggataaaaaggtagtcaaacaggccaggaaaaactttcgaagcaacttaaaatcagcccgtatgcattatcggaaagaagttaggaccttaagacagactgttcctaaaaaaggacgatttcgtaaaccagcccaaaattctctttttcaggaaaagaaaacagagttaaaagaaaatctactcagtagccaaaaagaagcagaagagaagttcttaaagggaattacctatgtgtctcctagactgttgaaggtaaaggaaatcaagaggtatcgacttccgcaagctcaagagcgtttgcggacggcaagaaaacatttgtcagaagtgaaactaagtgagaagcaaaaggcagttaatcccaagtttaccttccaaaaagataaatcttccttgaagtctcgctttcagtttcatcaagaaaaatcatttgatcgactcagtgcagaaaaagaagtgagttctgccaaacgtgaggtcaaacaactcaagaaagtccaaaagtctaagaaaaactctatcaaagtcaaagttggattaggcttagctgcatctgaatcgcttgacttggtggcacaggatgatgatttagatggttttagaaccttaaaggataccagcttgaaagccagacgctatggcaggtttacctatcaagcaggtaaagtggcggtgaaaagtggtcagactggtgtgcattttacaaagacgaaagtggctcatggaaaggaacgattccagaatttcaaaaagggaaaaggattcatacgccaaaaacctcttaaaccacaaagacgctaccaaacctttttaaagcatgccaaaaagcacagtctagcaggagttaagggggttgtccaagccattaagggaagtctgaccttcttttctgcaattgcgggaaatcctttgacttggattgtctcaggcattctcttgatactccttttgatgatgagctttttcatgagtgtctcaggtagcagtgtcattcaacaagatgagatagaattgagtaagagctacacccacatgacgtgggaagatgcggaacatactagaactaacgaaaaaggaattacctattacaccaagattgatgaggtcatggtttacatgaatcatcaataccaagactacaagcttgacgatttcatggaaaaaagtggtgcgacctacaaagcatttctcagtcaagtctggacggacttaaatggtggagactctattaaatccatgtctgacttgtataaagaacctgcttacaagctgtcagatgaggaccaagaagaactaaaggagttgaccgaagaaggcaactatttagcccttcaagaattggacaatccttttcagggacagactgatgaagatagtttaagtatgttataccgatatggttatgaggtcattgatgaaaaaccaacgcttcatcaccatatcatcttagaagcaaaagaaggtcaagtcattgtggctccgatggatggcaaggtatctcttgatggggagaacgttgttttgacatctggtaagggagtcaataagactaaactaaccttgtttggcattcattcaggtcgagtgagtgaacatcaacaagtcatggcaggagacattattggtcagaccaaggatggaacgggtctaaaagtcacctatcaaaaggttgatgatgacacgaataagttggtctatgtcaatccagctttttactttccaaaagtgattcaggttcagaccaccattcttccaactattggtcagtttggtggcgaagagttcgagagagcaaaggctatttatgactatcttaaaagtaaaggtgtgactaatcaagctatcgcagcgattctaggaaattggtcggtagaatcttctattaatcccaagcgtgcggaaggcgactatctatctcctcctattggtgcaacagacagttcgtgggaagatgagggctggctctcactcaatggtccaactatatacaatggacgttacccaaatattctcaaacgtggtttaggcttaggccaatggacagataccgcagatggttcacgcagacataccttattgctcgaatatgccaaaggaaaacatcaaaaatggtatgacttagagttacaactgaatttcatgttgcatggggatagtccttattacaccaactggttaaaggacttcttcaaaaattcaggaagtccagctagtcttgcccaactctttctcatttactgggaaggaaatagtggtgataagctgcttgaacgacagacacgagccagtgagtggtattaccaaattgaaaaaggcttcagtcaactcaacggtgggacagcacaaagtgatccaaaagcacttgaagctgtacgaggagatctttttgaaaactctattccaggaggtggtgacggtatggggtatgcctacggccaatgtacttggggcgttgcagcccgcatcaaccaactgggtcttaaactcaaaggtaaaaacggtgagaagattccaattatcagtaccatgggtaatggccaagattgggtgcgtacagccgaaagtctcggtggggaaactggaacaagtccgcaagcaggagccatactctcattttcgggtggaggacatggcacaccaacagaatacgggcatgtggctttcgtcgaaaaagtctacccagatggctcattccttatctccgaaaccaactataatggcaatccaaactacaccttccgtagaatatctggagtggatagtagcttgagttttgcatatacgacgaaataaaaaggatatgctaacaaaatgtataaatgttagcatatcctttttaattttttggtcactattaatcagaatttatagaaatgagaactgctatgagacgaatcatctcatcaagaacatctgcaagggaaatcccctttgtatagctatattttttcgaataattttgccattgtttattctgaatagggtcagatttgaacctctcgagtagttcaataatcttttcaaaatcgagctctgtttcgcgatatgaaaatgttctctgacaggcatttttcaactgaatgaagtcaatgtcttctttctttagttttgatagaatataaacatcataaaaatctttgcttctgctgttcaagaagttacgtgaaaagatggtttgaagtttctcagctaggattgtttcaattgtataagcaatgattggaaaattttcttcatcaaaaatagctttatagtcgtatgtaatcggctgaggagttacaacatcgcctgtcgcaatatccaaatggataacttgtttaatattctcaagttggcacaaaattgttgctcgatagccaccatagtcatcactttctttaatagctgtgatggattgaatcacaaaagatataccttcttctgaatctgctaaaatttctttgagttgctgcttcacagtatcttctgaaagtgtgatttgatggaacaaaaaatcaatatcaaccgtgctacgagattcaactccaataacatttgacagtaggaatcctcctttgaagatatagtgatttgaatagctactctgacttaattttttcaaaatcacttctagaaagtaataggtcatcacggaattaaaggttaatccagtattctttgatattttatgacagagtgctgttagcttagctttattcatactaggacctccagagtttgtttgaccttggccaaggtgttcatttttgtcgcatattcatagagttttgtaagatttttttgaggatagtttccgtaatgttgaagtgttttgacaaaaagctcagtatctattttttctcgatgaatcaccaaatcacagataatacgttcgaaatcatacgctcttacctcgtttcccataggggtttttacaagagtaattcctaattcgctatattccttagaaacggaatgaatgttcagattagctggaggagtattaaaacggtaacctctaggaatggttacgtcaaaatattgaggaatttcatctgtaaattgttgcagataaagcgctgagatatatgagaaaacagcttttggatatcggtactgaaagaagtagtattcgtcgtagtctccattctgggttaggaaaattcctttttcgacgcggtatagaattccttctttttctagtcttgtcaaatagattgttggaatatttagagctttacaatctttataggtgataataccattgtggttttctataaattcaagtagaatctctttttttgacatgcttactcctttctatgttgcttttacactacaattttacaacatttgtagtgcaaaagcaacattttctttcccctgaactgattgtgataacaaaatcaagccttcttttttatgatgttattgaacttgggctacgagctgttcaaaaaagagagtttctcctagaacggaaagttcttcgtcaaaactcctatttttgtcgtgctcgcttaacgccctcgtatctaataaagagtgacaatttgttgctacataaaaaagaaaagaaggactatttatgaccaaaacatgtaatcatcactttcttgtcaatcaggaaaaaggcgagaaacacgtctttcgcaagagtaaaaaatatcgcactctatgttccgttgcccttggaaccatggtgaccgctgttgttgcttggggtgggacggttgcacatgctgatgaagtggtactatcggttgactccaccattcaacgaacggaaaatccagccacgaatttaccagaagcacaaccaaaccctgtttctgaacaaactgaaagtttagggtcaactggaaaatctaacggtgcaattgcagtcaccgtaccacatgagacggtaacacaaacagttgaacaggcaaaggctgaaggtgtttctacggttgaagatagcccaatggatttaggaaatacaacttctgcggcagaaaccaaccaacaaatttcaaaagctgaagcagatgcccaaaaccaagttgtggctatcaatgaagttactgaaacctacaaagctgacaaagcagcttatgtggatgaaaaagctcgcatcgaacaggaaaataaggagctgtcacaggcctacgaaggggccaaccaaactggtaaagagacaaatgcttgggttgattctaaagtcaatgacctaaaatctcagtatgcagatgctgatgtgacagtaaaagaacaagtagtttcatcaggaaaagggacatctgtacttgactatacagactatggcaaggctgttgaaaccattcaatcaactaacgaacaagctgtagcggattatctaacaaagaaaaccaaggcagatgatattgttgcgaaaaaccaagccattcaaaaagaaaatgaagctggactagctaaggcaaaggcagataacgaagccattgaaaggcgtaatcaggcaggtcaagcagctgtagatgctgaaaaccgtgcaggtcaagctgcggtagatcaggctaatcaagagaaacaacaattagtttcagatcgagcagttgagattgaagtaattactaaacgcaatcaagcaaaagaagtcgcagccagaaaagagaatgaagcaatcgatgcctacaatgccaaagaaatggaacgttatcaacgtgacttggccgagatttcaaaaggtgaagaaggttatatttctgaagcccttgctcaagccctcaatctcaataatggtgaaccccaagcacaacatggggctattacccgaaatcctaatcagatcatttcaactggcgatgctatgctgggtgggtactcaagaattttggattcaacaggattctttgtctatgatagcttcaaaacaggtgagacccttagttttaactatcaaaatcttcaacatgcacgatttgatgggaaaaagattagtcgtgtgacttacgatattaccaaccttgtatcaccagctggaaccgatgccgtgaagctggttgtaccaaatgatcctaccgaaggctttatcgcctaccgaaatgatggaaatggtgactggcgaacggataagatggagtttcgcgtagttgctaagtatttcttggaagacggttcgcaagttaccttctccaaagaaaaaccaggtgtctttacacactcgtccctcaatcataatgacattggtctagaatatgttaaagattcatctgggaaatttgtgccgattaatggttcaaccgttcaagtgactaatgaaggtctagcacgttctttgggttccaaccgtgcaagtgatttgaacttacctgaggaatgggataccacatcaagtcgttatgcttataaaggagctattgtctcaacggtcacatcgggcaatacctacacagtcacctttggacaaggcgatatgccacagaatgttggattatcttactggtttgccttgaataccctaccagtggcacgtacagtaacaccttatagtcccaaacctcatgtaacggtggaacttgaacccgttccagaaccgattacggtaacaccagatgtctatacaccaaaaacctttacaccagaaaagcctgtaaccttcacgccaaagcctttggaagaagtggtgcagcctagtctaactttgaccaaggtaaccttacctgttaaacctattccaaaagaacttccaacaccaccacaagtaccgactatccattatcatgcgtaccgtttgacgacaactccagagattatgaaagaagtgatcaatagtgaccaagctaatcttcatgataaaactgtcgcaaaagattcaacggtgatttatcccttaacagttgatgccttatcgcccaaacgtactcaaacgactagtctcatttttgaggactacttgcctgcaggttatttgtttgataaggaaacaacacaaaaagagaatggaaactatgcccttagctttgatgagtctaagaattttgtgaccctgactgccaaggaaactttgcttcaagaggtcaatcaagacctcactaagtcttatcaactgactgctcccaaactttatggaactgttcaaaatgatggggcaacttattctaatagctacaagttgcttgtgaacaagggaacagccaattcctatacagtcacttcaaatattgtgacggttcgtacaccaggtgatggggaaacaactacacttattacacctgacaagaacaatgaaaatgcggatggtgttctcattaacgatacggtcgtagccctcggtacaaccaaccactaccgattgacttgggatttggaccagtataaggaagatcgttctgcaaaagagacaattgcacgaggcttcttctttgtggatgattacccagaggaagtgcttgatgtggtggaaaatggcacgtctgttacaacccttgatggtcagaaggtatcaggaataacggttaaaacctatgcttcgttaaatgaagcacctaaataccttcaagataaatttgctcgtgcaaagattacaccgacaggtgcctttcaagtctttatgccagatgataaccaagccttttatgaccaatatgtcaaaacaggtacatctttagctttactgaccaaaatgacggtgaaagatagtctctatggtcagacaaagacctatacaaacaagggttaccaagtggatttcggcaatggctatgagaccaaagaagtgactaacacccttgtttctccagaacctaagaaacaaaacttaaataaagacaaggtggacatcaatgggaagccaatgctagtgggaactcaaaatcactatactctttcatgggatttggaccaataccgagggattaaagctgacaactctcagattgcacaaggattttactttgtggatgattatccagaagaagctttattgccggatgaagcagctattcagtttgtcacatctgatggcaaaacagtttcaggaatcacggtgaaggcttattctcaattatcagaagctcctaaaacgctacaagcagccctttcgaaacaaaaaattcagcctaaaggagcttttcaagtttttatgcctgaggacccacaagccttttataactcttatgtgaccaagggggagaatattactattgtcactccgatgactgttttagaaaccatgattaattcagggaagtcttatgaaaacgtggcctatcaggtggattttggacaagcatatgaaactaatacggtgaccaattttgtccctaaagtaactccacacaagtctaataccaatcaagaaggcatttcaattgatggaaagactgtccttccgaatacagtcaattattacaaaattgtcttggattacagtcaatacaaggacatggtcgtgacggatgatgttcttgccaagggattttacatggtagacgattacccagaagaagcccttaccctaaatcctgatggcattcaagttttggataaggatggcaatcgtgtatctggtatctctgtcagcacctacgatagtttgtcagaagctccgaaagtcgtcgaagatgccatggctaaacgtcagtttacacctaaaggagccattcaagtccttagtagcgatgatcccaaaacattttatgagacctatgtgaagactggtcaaacattggttgtcacgcttccgatgacggttaaaaatgagctgaccaaaacaggtggtcagtatgaaaatacagcctatcaaattgattttggcttggcatatgtcacggaaacggtggtcaataatgttcccaaactagacccacaaaaggatgtggtggttgacttgtctcataaaaataacagccttgatgggaaagaagtggccttgaatcaaatcattaactatcgcttagttggagcaatgattccaagcaatcgtgcgacagatttatttgaatatggttttgaagataactatgatgaaaagcatgatgagtataatggtgtttatcgcagctatctgatgacggatatcaccctcaaagacggttctatcttaaaagaggggacagaagtcacgaaatataccttgcaacaggtggatacagaaaatggcctcgtgtcaatttcatttgataaatccttcttagagactgtctctgatgattcagcctttcaggcagatgtttacctgcatatgaaacggattgcggctggtcaggtggagaatacctatcttcatacagtgaatggctatgtcatcagttcaaatacagttgtaacacatacacctcaacctgaagaaccaagtccaaatcaacccacaccacctcaaccaccaattgagactattgaaccgcctgttccagcaagcattttgccaaatacaggggaacaggaatcccttttgggcttgattggagctggtattctacttggtacggcttatggactgaagaaaaaggaggagaagtagatgaatccaaaaactatttatgaaaaggattcagaccaagatggtttgacagatgctcaggaactagctttgggaaccaatccgcagtctgttgacacagatggtgatggtcaagctgatttagaggagctacaatctggaaattcaccactagtcccacaaaaggagttgtgtgatggcttggaactttgacaccatgaaagaggctttgtctgaaatggagaaggtcgattaccaagagtttatcaaggcctttctctctttggaattaagtatttctgatagaacaatcctcaatcaggtttatcaagattatatggatgaggatgacctatccttgattagtgatgagctacgagttaaagttgatagttatcaggatgaagtacaggtagatatgactgacattctggaaaagttgtaccgaacaggtgaaggctctaattttattatggatttaatgtcctcaaatagtctttcagacaccttggaacagtatgaggttttggatagtgacgattattcactacttagccttgaaaccttacaggccatgattcaacaggacttggctatttctagtcaggattattttggagatttggttcgccttgccttgcaaaaagatttactagaccagaaaagtcatttcttacaacactatgtggcaactgtaatggatggtattccacaagaaagagaccaacgagccttggtcctagattaacacaaagggctgagaaacactctcagcctttttaaaatgggagggaataatgaatcaagaagtcttactacaaatgatgagagcaaccattcctcgtgatagagccttgcttgaagcgtttttatattaccaagcagagcattttgatgaggagtgggatagtctcgtttatcagtttatgaccaataggcagggaatcaaaagatctgttcaggtacttcactttgagacagatgtttcagcttttgtccaggctagtccttatgatactgctcatgatctattgacctatacacaagttttcggccaaactggtctccaaaaactcgacaaactatcgccgtctgaaaaagacttggtgattgaagtggccttgttcaatctggccactcgttttcaactattagactcaaatggacactaccaaactatttcaccagattctctattacaaaagagtaggggagctaatttggtcaatgtttatcgtgtggcaaataatttagcggatcggattagtcgagatattgaacagtttctcttaacttacgagcctgagcttgaaataaaagtagatgaaacagttctagaaaatgaagaaactggtgatgagcacaaagctagtgttcatcaagcaatatcatttagagaagatggctctctcatcattgctagtttggatgtagatttgtctcaactagatgttcaaacaggaaaaacaagtcatctgccagcttatgaagcgttatctttacgacgtaaatttgagattctaacatattttgaccaaattcgaaatgaacgttccaaagtcccaagttttagacgaggtgattttgatactgagacggaaatgacaccagtctttgagggcgaggagttacttacctatctagaagctgatggcactccctatgagctgaaacgaacgctgaccacagtcgaagaaaaggaattagaaaaaattggacaagccatttggatagaaaatcaagaaaaattgactcagctagggattgagctatctcagtttgaatcagaccaagtcggtattttattggatgcggcaggtcgttttcgtttgaaaaatgcggaccttgctttactaggtggctatcccaaagcctcggtaactcaactagcccttgcgacagaactactccaaatgggattgagtcatgaaaaggttgaatttttctttggtagccagctttccattgaagagctgcgacaagttgcctacgcctttttacaccaagaactcagcagagaagatgcggagcaatttgaaaaagataaacgcaatcagccagatttaaccctcagagattggaaaagcaagctagagaaagctgagtcgaaagtagtagttgatgaagaattcgcggaaaatccactagtccagagagtattggacacttatcctctggggtcattggtttcctataagggacaggactttgaggtcgtgtcggtcagcgatgctcgattgaacggtttgattcggattgagttagtcaatgatttttcggatatcattgaacaaaatccagttctttatatgaggacctgggaagaagtcaggcaggcacttcatcagctaaaggcagaaaaacaaacagagttagaagaagcggaccaagaattaaacctattctcatttctggaagaggagccagttcagagtattggactattggaaccagatggttcagaaaaaggtcataacgatactgaacttgaagaatcagataatcaaattcctgaagaggaagtcgtcgaaacaattccagagattccagtaacggacttttattttccagaagatatgacggacttttatccaaagactgctagagataaggttgagacaaacattgcggccattcgtttggtaaaaaatctagaagtagagcaccgcaatgcttcattaagtgaacaagaactccttgccaagtatgtgggctggggtggacttgccaatgatttctttgatgactataatccaaaattttctatggaacgagaagaactgaaaagcctagtcactgataaagagtattcggatatgaaacagtcctccctgacagcctattacacagaccctgccctgattcatcagatgtgggataagttggaaagagatggttttacaggcggaaaaatcctagacccttccatgggaacagggaatttctttgcggctatgcccaaacacttaagagaaaagagtgagctatatggcgtagagctagataccattacaggagccattgccaagcaccttcacccgaatagccatattgaaattaagggctttgagacggtggcttttaacgacaatagttttgatttggtgatttcaaatgtgccgtttgccaatatacgaattgcggataacaggtacgataagccttatatgattcatgactactttgtcaaaaagtcacttgatttggtccatgatggtggacaagtagcgattatctcttccacaggaaccatggataagcgaacagaaaacatcttacaagatattcgtgagacaactgaatttcttggaggggttcgattgcctgactctacctttaaggccattgcaggaacgaatgttacaacggatatgttgttcttccagaaacacttgaacaagggatatgtgacagatgacttagccttttcaggttccattcgttatgaaaaggatagtcgcatttggctcaatccttactttgatggagaatacaatagccaagtgctaggaacctacgaggtcagaaattttaacggcggaacactttctgttaaggggactagtgacaacctcatcgcaagtgttgaaactgctctacatcaagtaaaagccccaagagagattgatagaaatgaaatcatcattaatccagacatattgaccaaacaagtcatggatacttccattccagctgaaatgagggagaatctgggtcagtacagttttggttaccagggttctacagtttactatcgagataacaaaggcattcgagtggggaccaagacggaagaaatcagttattatgtcgatgaagagggcaacttcaaagcatgggacaccaagcattctcaaaaacagattgatagatttattagcttagaggtgactgatagcactgctctagatgtttatgtgaccgatgatgcagcaaaacgtggtcagtttaaagggttatataaaaagacagttttctatgaagctcccttatctgagaaagaagtagcacgaatcaaaggaatggtggacattcgtaatgcctatcaagaagtcatagctattcaacgctattatgactatgataaaggtgagttcaacgacttattaggcaagctcaatcgtacctatgatagctttgtcaaacgctacgggtatttaaacagtacagtgaaccgcaatctttttgatagtgatgataagtattcgcttctggctagtttggaagatgaaagtctagatccaagtggaaagtctgttatctatactaaatcccttgcctttgaaaaggctctagtgcgtcctgaaaaagaggttaaaaaggtacatactgcccttgatgccttaaattcgagcttggctgacggacgaggtgttgatttcgattatatgatgtctatctatcaggttgaatcgaagatgaccttgattgaggaattaggcgacctcattatgcctgatcctgagaagtatttgaatggagaattgacctatgtttctcgccaagactttctgtcaggggatgtcgttaccaagttagaagtggtggacctatttgtcaaacaagacaatcaggactttaactggtcgcattatgcagggttacttgagacggtcaaaccagcacgtattactttagcagacatgttggaacaatcaaaaggcttcttaactaacattcagacggtgaaaattcctaatgattgtcaaggtgtattttttgttcaagatagcatgaaacatattgatgaactaagcccattagcaaaacacaatctgaaaaaggttgttaatcgcaatgcttatttacctgattctgataagatagaattaagtaaggaaattgaaaataccaataaagatcaatcccaagaattggataaagacgtaccagaaaaaaatgaagtgactgtaaaaatgttccaatttgcgaagtcaattaatcgcttgttgagtggtaaccaactacagaaaaaacgaaacctagacaaattgattaaaattttgtataataggaattgaagttaaattagatgctaaaaatttgtaattaagaaggagggattcgtcatgttggtattccaaatgcgtaatgtagataaaacatctactgttttgaaacagactaaaaacagtgattacgcagataaataaatacgttagattaattcctaccagtgactaatcttatgactttttaaacagataactaaaattacaaacaaatcgtttaacttctgtatttatttatagatgtaatcacttcaggagtgattacatgaacaaaaatataaaatattctcaaaactttttaacgagtgaaaaagtactcaaccaaataataaaacaattgaatttaaaagaaaccgataccgtttacgaaattggaacaggtaaagggcatttaacgacgaaactggctaaaataagtaaacaggtaacgtctattgaattagacagtcatctattcaacttatcgtcagaaaaattaaaactgaatactcgtgtcactttaattcaccaagatattctacagtttcaattccctaacaaacagaggtataaaattgttgggaatattccttaccatttaagcacacaaattattaaaaaagtggtttttgaaagccatgcgtctgacatctatctgattgttgaagaaggattctacaagcgtaccttggatattcaccgaacactagggttgctcttgcacactcaagtctcgattcagcaattgcttaagctgccagcggaatgctttcatcctaaaccaaaagtaaacagtgtcttaataaaacttacccgccataccacagatgttccagataaatattggaagctatatacgtactttgtttcaaaatgggtcaatcgagaatatcgtcaactgtttactaaaaatcagtttcatcaagcaatgaaacacgccaaagtaaacaatttaagtaccgttacttatgagcaagtattgtctatttttaatagttatctattatttaacgggaggaaataattctatgagtcgcttttgtaaatttggaaagttacacgttactaaagggaatgtagataaattattaggtatactactgacagcttccaaggagctaaagaggtccctagcgcctacggggaatttgtatcgataaggggtacaaattcccactaagcgctcgggaccccttgtaggaaaatgtcctaagtgtggcaacaatattgtattaaaaaaatcgttttatggttgttcaaattatcctgaatgtaccttcactttagctgaacattttagaaagaaaaaactcaccaaaacaaatgtaaaagaattactagagggaaaagaaaccctggtaaaaggaatcaaaacgaaagatagaaagtcctacaatgccgttgtaaaaatcggagaaaagggatatattgattttatctctttttcaaaataagcataaaagccctttaaagagggcttttgaggtaacagacaatggcaaagacaatttttgaggaaatgggcggcaaatacgaaaggcaaggcgattatttaataccgtgcttaactgtacccgccgaagaagaacagccgataggcatctggggacagcggcatttggattatctgaagcatcactgcaaagttacatacaccaatcttcttacaagcggcagacttaacgcttaccttgccgacattgacagacaggcacaggaacgctttgaaaggctcatagagggtatgaaacaggcacagggcataacggaacagctaaaggcagaaaacgccttagaatggacaggatgcctcaataacataagggcttgtgcgagggagattgtggaaaaggaaattatttttgcataaacagatgattagtggcagggggaaatcctgccgctttttctgctttagtttgtcagcttgacaaataaagggttaaggaatataattagattcagtattatacaaggagttgataaatatgcggcaaggtattcttaaataaactgtcaatttgatagtgggaacaaaaagtagcagtcccgtttcacttttaatatggggcttagttttttgtacccagtttaagaatacttttatcatgtaattttatatgcccgaaaacatataagtgttttggggctattggagttatttacccagtgataggagtatttatcactgggtatttttatgcccttttttgggtgttgataggaggaaaatcacatgaaaataattaacttaggcattctggctcacgttgacgcaggaaagacaacattaacggagagtttattgtataccagtggtgcaattgcagaaccagggagcgtagataaaggcacaacaaggacagatacaatgaatttggagcgtcaaaggggaatcactatccagacagcagtgacatcttttcagtgggaggatgtaaaagtcaacattatagatacgccaggccatatggattttttggcggaagtataccgttctttatccgtattagacggagcagtattattagtttctgcaaaggatggcatacaggcacagacccgtatactgtttcatgcactacagacaatgaagattccgacaatttttttcatcaataaaattgaccaagaggggattgatttgccaatggtatatcaagaaatgaaagcaaagctttcttcggaaattatagtgaagcaaaaggttgggcagcatccccatataaatgtaacggacaatgacgatatggaacagtgggatgcggtaattatgggaaacgatgaactattagagaaatatatgtcagggaaaccgtttaaaatgtcagaactggaacaggaagaaaacaggagattccaaaacggaacgttatttcccgtttatcacggaagtgctaaaaacaatctggggattcggcagcttatagaagtgattgccagtaagttttattcatcaacgcctgaaggtcaatctgaactatgcgggcaggtttttaagattgaatattcagagaaaaggcggcgttttgtttatgtgcgtatatatagcggaacattgcatttgagggatgttattaaaatatctgaaaaagagaaaataaaaatcacagagatgtgtgttccgacaaacggtgaattatattcatccgatacagcctgctctggtgatattgtaattttaccaaatgatgttttgcagctaaacagtattttggggaacgaaatgctgttgccgcagagaaaatttattgaaaatcctctccctatgctccaaacaacgattgcagtaaagaaatctgaacagcgggaaatattgcttggggcacttacagaaatttcagatggcgaccctcttttaaaatattatgtggatactacaacgcatgagattatactttcttttttggggaatgtgcagatggaagtcatttgtgccatccttgaggaaaaatatcatgtggaggcagaaacaaaagagtctactgttatatatatggaaagaccgcttagaaaagcagaatataccatccacatagaagtcccgccaaatcctttctgggcttctgtcgggttgtccatagagccgctccctattggaagcggagtgcagtatgaaagcagagtttcacttggatatttaaatcaatcgttccaaaatgcggttatggagggggttctttatggctgcgagcaggggctgtatggatggaaagtgacagactgtaaaatctgttttgaatatggattgtattatagtcctgtaagtacccccgcagactttcggctgctttcccctatcgtattggagcaggctttaaaaaaagcagggacagaactattagagccatatctccactttgaaatttatgcaccgcaggaatatctctcacgggcgtatcatgatgctccaaggtattgtgcagatattgtaagtactcagataaagaatgacgaggtcattctgaaaggagaaatccctgctagatgtattcaagaatacaggaacgatttaacttatttcacaaatgggcagggagtctgcttgacagagttaaaaggataccagccagctattggtaaatttatttgccaaccccgccgcccgaatagccgtatagataaggttcggcatatgttccacaagttagcttaacagcttgcaaaagtcatataaaatgagatttgaaaggattagagactaattatgatgaaatgcgaatggatattgtgtcctgtttgtgggagcaaaacccgtaataaaattaggaaggacactgttttggagaattatcccctttattgtccaaaatgcagacaagaaaagcgatcaaaattgaccgcttttttatttttctttgaaatatgctcgaagaatatattagagatgatttaaaaattcattcagctgtgagaactgcgaaatttatcgctagtcgtcttgattgtttagtaaatcatattttccaattgagttacgaggtaatatacctctaatttcatttataacatcagtactttccatacatttacaccccttgcttatggttaataatctttgctaatctttaaaaatagtcattttcaacatattttttatacatgtcctcggtatatcttgttatgttcttaccatactctggataatcaaaccccagtagttctgctacctctttggacacttccctgaacaattggtggcatataaataatgacttccaaatattttcataggaatccatgcgatatgtagataataatctattccatagatcttcatcaatgtatttgttaatatacttataatttttcccaacacttaatgaaaattctgtctttatcccaaccttccacgacatcatcctaagtagttcaaaccgtagaatctggttcagatgatcgattgcaaacagtatctctttgcggcacaatcctttaataacataaggtgttacattccaaaattcattgcagcaatcatcatactcccttgcgcttggctttcttacatgataatctatatcagtcggaactatgtcccttttaattctacaatctttatcaattagaacctttattaatttatcgccctttaggtaattatctaactcttccaagggcaataaggtaagatcaattttattgtaatcatcaaatagcataagataggaaaatcccttttcttcaggtgggaataattccatatcctccggcttttgcatcattattatattcccaaattgattaagccagtcatcattagatataaacggttctatatcacttacaaaatatgtaatatcataatcctgaaattcatctttaggtatattaatatttgcgcgtgacccctcaagggtcacaattcgaatacgttcatcctgttctgctaaagaaagtactaaatccatcatttctttttctgatctcatttacatactcctcgtttattttttctatattattacatcttcttttttgccgatacaatcagcatcattgggcgtcgcatttcatccgccatccccggaatatccatcatgttctctggcggctgtggctccacaatctgatttattataaaactatttgaaagcagtgtatttagatatgtggtcagtgttctatgatattttgtaaccttttcttccaaaaacatagctgtccgtttgccctcataataataattgtccaccgggaaatgcagtatttctcctttttcgttataataccagtcttgtgttccatgagcagtaaaaacaggatgttcaactgtaaaaactaaattgccaccagccttcagcatcctatatatcttttttattaaattctcatagtctgctacataatgaaacgcaagcgaacttagtattacatcaaagctctcctctgggaaatccacatcttctatggcacagcattcatattcaatctgtggaaaatgggtttttccttttgctacttcgagcattttatgagaaatatcaacacctactacagaggaagcaccgttttccatcgcatatatacagtgccatccatagccgcatcctaaatcaagcacacgcttacccttaaaatcaggtagcatctttttcaaagtctcccattctcccgcaccagccagtcctttctgcgagcgactcatttgactgtatttttgaaaaaggctatgttttaatatagtgttgaaatatagccttataaaaattataggtgggattgtccacctataattctcaatagatgactattgttcattaaatataattttttattttcttctttcatacgtataatatgtgtatggtatttccccctcaattcgctcttcataggatttcacaaaatcatcagaagaaatctctggaaaatatacattgccatcaattattttatctataactgtaatatatattctatctgcataggtaaatgactccttgtacacctgtccaccaccagcaacaaatacttcgtcttcatcttttgttaaatcgaatgcttctgaaagcgattttacagttgcacaattctctgattcaatacattgcgtatttgaaataagtattgtttttctgttaggtagtggcttacctatttcttcaaaagattttcttcccatgattattgttttacctatcgttaattctttaaaccttttttgttcaccctttattttccatggtataacaccattgtttcctattacattattttttgctacggcaactattaatgaaatcataactatccacctttcattagttagtaaaaaactaccattgttcattagattatagtttttaacaacgcttattataacataatttacaaaatatcacacatgctatacatacattggctctctatttttcaaatcttttattttgatatatgaatgggttacattgctttgaaccataaagttcttagcctttattatctctttatctgtatcaaatatttgaagccatttgaaccacttaatatagttgttgatatattttgttgcaacaccattaaacctattcatccatttctttaaattgctatgaagagcattaatatgttgaatatgatataatccttctttatgttttcctctttttatacgtttatgttctaatgataaatcatttgcaaattgaatataacttttatgactatcagtacaaagtatagaaccatttgccatatgtccatcatataatgtttctaattcattagatgtaattctacctttacatgctaattccataattaaattaccttgcctatcaatagcagtagcaatgcaaacttgttccttggagataccccttttcttaacttgtttccctcttttacgagagtgtcttggcatgttagaaggttttgtacctttaaaactttctgcaaagaatacttcatctgcttcaacaacaccatcaacgtatcctttacctaaaaatgtgcttatgcaatcgagaattttatgtctccaaaagaaacttgttgctatgttaatttctacaattttagcacttttcctaatagagtagccattaatcatgcacttagcgtatttaagccacttatccaatgttttcttacttttataggtcgcagaattagtaaagtccgtaaaagttttcttacaagatttgcagatatatctttgtttaccattatactttccatttctcgatatagtttcagagccacaaagggggcatacttttcccttagaaaatctaaattctttaacttcttgttctacttgacttgtttgtgaacctaagacaagaatttcttctaaagttgatagtatctgttctttctgatgtaatggtaacttttcaatatcatttaatatagactttacatttggcataattctacctcctaaacactattctatctatattataacctattttactgttaaatatcaattttcaacattgatttaaaacatagccttgaaaaaatatattatcatcatatttgttttctttcatctgaactctcctcgtttaaaaagttatttatctccgatacaatttcattcacttctttataaagtttctcggtcatatcgtagcattcaaaaagagaaagaccgagtacttcaaaaatatgattaactctttcggcatatttttcaggtttatattcaaaagtttcaagcagttttatagctttcttttcgttaatgcaataagcattattacatgcaaatagtacttgatttaagcatgaaataatacgaaaaatatggcctgcaatataatatttatcctctacccccgcatttgcttttacaaacattaaagagaattcagcttcaaatataaaaaagttcatcaagcttttctttagagcagtagggtaaatttctgcctgcttttttaattcgcataagctttcgttcttagcatatagtattttactaatcgctaattctccacgatacattgcacttatataaccatggggatgcccggtctgataattggcagtaacaattccttgctccgtatctttgattatttgttctacccgttttatatcacgtaaaatcaagtcaacatgatacccatttataaataaccatccgccgccattaatccaatcaccccacgctccgggaggcacaacaaggttgtttctatttttatcatccaattctgtagcaatttgattaatcgctgtcaggtcaaatgagtctgaattgtaatagattccgatatctatatcagaattttctgtatgggtgcctcttgcacgtgagccccctaatacgatgccttctataaaaggcaaagatgataatttctctgttactatttgaataacattacctaccatataaacatcctcctttattcgttagatatttttatttcttctccatctggtaaaataaatgcctgcacaaacttgacacctagcacatcagcaatggccttcaactcatccaaggttactgtttctcgttgtaattttttattgaaattctgtggagtctggccaatacgtctagcaagttcggaaacacttatattcatttgctcacacagttctttaatcatttctgccgtagtcatacagcacctccaagtttacgctaagaatattataaaccatttggttgataaacacaatagttattaaaatattattataatcagcaagcaaaagaaaacccacaactctactgtagagtcatgggctatttacttctggttttcatatttccatttcgatgccagatttgaaggctatgacgaagtggccttcatagactgtaacgctctggattatcttcctttgtcttttattggtataatattatgtaagaaaaaaaatagatttgagtaagacatgagaagaaatttgttaagtacagcgtattaagtaattaccctttttactcatgattttgtattgtaacttagatatactggtgtaaaggaggttcaaattcatgaaaaaagtaataccgtatgcgttattaactctatcaatgttttttctattcaatgccatccgaatatatcttgagagtaggtctctgtatgttgtcgatgttttgttattcatagtctttctagtatgtagtttcaaatttagaaagcaataatgtagaataaatacaaagatatactatcttctacatttgataagttataaattattcagatggtcataatttggttgttaaaaagccccattgcagctgtagtaggaaacttataatctataggagagaggaacagattgattctatctttttgatgttaagttagtttagaaatttgtttctgaagtttgtaacttgtcgaaaactgagtgactgacgtttgatatccttgatgagcttatcgattgctttaaattagtgttagaatagggaaattccgtcagatagcagttctaactgccgttgtacgacagaggttgagaaaggaagtctttaggtagtggaagtgtcggtgagtttttcggtgcagtattgagtgatctttatgcagatgggttgtgagatttagtgttttttgatgagagacacttcagtgactgtcatctgtttacaggatttacactgaagaagacatctttggtttttaacatagttggcatccctttgatattcagaatagatactgtagatttatgttggtaataacatctgactaaggtagtttggagctgggtaatcaagctcacgctgaatagtgatatgcgtgttgacttgaaaaaatggtctcgatttgatgttcttattttctaattcgaagagtactgtggtattctaaaattgttccataagcacttcctaatgatgattagggaggtcttatggaacttttttatatactcaaaaaactatagcctctgtatagattgttcctactacagaaattataggatatgtcttttattgtagtatatcttaaaaatatttagtttaaattattctacaaagtagttaatccggaaaataaagttatttggctcagttttaaagtaatcggagtgaaaatttttaatgttcttaaagagtcattataactatattttcttgaaaagatatttgagcaccaatttctgaaaactagttcagtagaatttggaatagagctggctacttcaaaacgcaacgaactataattcaacatctttatctattgaataggttctggtttgctatttttgatttttacagagtataatttgtagttaatcatatttttcttgtgataaaatttccaacttaatcttgatatgatgaggctatcactaataaaggagtaagccatgttaaataaagtgaaagctcgatttctgattggagtaggaggtttaatcgcagtcagttttatggtcatgattggctacacgattggctcacaaaccatttcaaagcaaacagcgaaccaaatacgagcagaagccaataaacttgtgtcaaagaaaaagcaagaggaaagagcgacagtcctatcagatgagcttgtcaaagaatttctcactcaatatttcaccaaggttcagctgggtgaaaataacgctcgtatcaagccctacatgacggactcggcattttcagaagaggaagcaaatcagaataaagcaattaatcaagtttataaagattatatgcttgactaccgatttgaatcagcgagtatctatgtcaatacagaaagcaatgttgcacttgcggaagttacctatcaagtgacctatgtttctgatttgagtgagcaacaacagcgaaccactcagacagaaatcaagacggttatgttatcctactccaaagtttccgacaagctcctggttaatcagttgaccatttggaatgggaaactggaggacatgaaagaagccacaaatggtgctaattccagcataccaacgatccaaggaactacaacaagtgagaacaactagcaggagacagtcttctgcttttttgatagggagacaagatgacacgaattaaaatagtaaaacaaaagaccattttagatgtggctgaaagtttgggttattccttcagacgtttatcaggacacatttatgaacacccagaccatgattcctttcggatttttgccgataccaatactttcaaatggttttcaagagatatacaaggggatgtgattgactttgttcaattagtggcaggtgttactttcaaagaggctgtatcctatcttgaaactggagattttgaacaggctacggtgatagaagaaacttatcaaccgtttcaatattatttgcatgaagaaccgattcagcaagcacgtatttacttaaaagacatccgtggcctaagtgatcagactatcaatacctttggtagacaaggattgcttgctcaagctacttatcaagcggagtcagttttagtgtttaaaagctatgaccataatggtgtcttacaggccgcaagccttcaaggtctcgtcaaaaatgaagaaagacacaaacgtggttatttgaagaaaatcatgaaaggctctcatggctatgtcggtattagtttcgatattggtaatcccaagcgactcattttttgtgaatcagttatcgatatgatgagttattatcagcttcatcacaagcagctatcagatgttcgcctgatttcaatggaaggcttaaaactttcagtgattgcttaccaagtcttgcgtctagcagcagaggaacagggaaaattggcatttctaaatacagtaaaaccaagcagacttagccattatcttcaggcaatacaagagacgacaaactttttccaaacccattcaaacgcattaacattggctgttgattacgatgaggcaggaagagaattttgtaaaaaattgttagacaaaggacttccaatcgttcaagatttaccaccattacagggacttgaagcaaagtcagattggaatgatattgtgaagcaacagaaggaaatatccttaagcaatcttattcagtcagcccagatacaagccattaagaatcatcctccaccaaaacgagagcgtgctatggaattgtgataacaaaatcaagtccgctatcataatctagaatgtgacaaggaggacgccctatgagtgtgattgaacgtctagctgaaaaagtagctaggcaagaagaaaaggtctcacgtgagactgagaaattagaaaactatcgtgaccaactacaaactgcaatgtatagcacctttatcaaacggcaacaatcaagtcagttgtcatttcatgaagcactagagcaagcctttggtaaagaatctacaccgcccccagattacagaaatgaggatacagaatgagtaaaacatggaattttgatcagccattagatgatgtgaaaacaacatcatcccatgaagaacgagctaaaatcgcagcactcttccataaacaggaagaaaaaccaattgaagaagtagactatgtggctgcttttgaacagcaacaaaaggagtcagaatctaaagatgtacaaacgctcgcatcaaccgttaaacaaagtcagccgaagaaggtaaatattacaagtgactataaacaacacttggctgataccattgcacaaaataacaaggacatttccgcctgtcagaagcaaattgaagaacttcatcaattgattgatgaaaagaaagtccaaaataaaaagttgcaggctatttcagtagccattgatgatttataagtcaggtagtcctatgcgggctacctttttacaatgtaaggagaagataatgaaattctttcaaaagaaaacccagaatcaggatcaatttaaacgactgattcatagactatcagagatgtcagatagtaagctaaccaaagtagagcaactcctagatgtggtctttgattctagtttcaagtctagtgagagagtggaaatatctagggacattataaccgatgaggaacaaagtcttgataagtcaattcaagaagcgaaaaataaactgaatactgagcagttggagaagcgaatagagcagtttaagcaatcgaagaaacctaaaaacggctaacgcaccaaatatggtgcgttatccgttttttatggtataatgaaagcaaatatgaggaggtctttatctatgatcggagacaatataaaatcactacgccgaacacacgatttaacacagccagaatttgcgaaaatggtcgggatttcacgcaatagtctgagtcgctacgaaaatggaaccagcactgtttcaactgaactcatcgaccgtatttgtcagaaatttaacgtttcttatgtcgatattgtaggagaggacaagatgttaactcctgtcgaagattaccatctgactttaaaagtagaagtgataaaagaacgtggagcagccattttatcacagctttatcgatatcaagatagtcaggatattgcttttgatgatgaatccaacccttggattctcatgagtgatgatttggctgaattgatcaatacgaaaatttaccttgtcgatactttcgatgaaattgagcgttacaatggctatttagacggtatcgagcggatgttggacatggtgcatcatcgggtggtggcttaatgaggttggaagaatttagtgaggctgcatttcagaaggccttacagcgaaccattcgggctttaatccgaggcaaaacaattccagaacaaccgaaagctatcttacttggaggacaaagcggagccggtaagacaacgattcatcggattaagcaaaaggaatttcaaggcaatatcattatcatcgatggtgacagctaccgttctcaacatcccaattacttagcactgcaagaaaagtatggcaaggacagcgtggactataccaagggatttgcaggaaaaatggtagaacatctggttgatgaacttagtacacaaggttatcatttgttaattgaagggactttgcgtaccactcaagttcctcgtcagactgctcaattattagcttcgaaaggataccaagtttccttagctgtgattggtaccaaaccagaattgtcctatctcagcaccttgattcgttacgaagaactttatgctatcgatcctaatcaggctagagcaacaccaaaagaacaccatgatgggattgttgagaacttggttgataacctaagcgagttagaaagagagcaactctttgaccaaattcaaatttatcaaagagatagaacttgtatctatgattctgaaattgatgagggatccgcggtagaagtgctacaagaatgcctctttgggcaatggagtaaagtcgaggaagagatgttgaaggccggacaggaacggttgggggaattagtctcagctaatggagagaagaaatgaaattaacaaaagtaattattaataattttagatcattcggtgatagtcaagttattggatttaacgatcaaactgtactgattggaaataatagttcgggaaaaacaactgtattacaagcattgagtaagctgttttcggataaacaaaatgatagaataattcggaaaagtgattttcatttaccaaagggattaagacctggcgaaaatagtaggaccctttttatagaaactatttttgagtttgatgaactggatggaactgcttacagtccagccattccatcatttttcgaacactttacagtttctcaaggtgatgcaaaaacttttctacgaatcagattagaatcttcctgggaagatgatggaacagttgaaggaagtattgatactcaaatttattatatttcatctgccgaagatattattaaagatgaagataagcaccgtgctcctagaaaggatttggataaaattagggtactctatgtacccgcttcaagaacgcctgagaaggagttgggaaatgcttcaggtagtatgttaagtaggctagtaaatagtataaattggaccgacgatgagataaaagaaattacaaacaaaattgatgagttgaataatacctttttatctgaaagcggagcattaacccaaatcaaccaagaaatccagaaatcgtggaaactatatcatgaagacaaccgtttttctcaggcagagttgactattaattcttctgagatggcgggagcccttagacaaattgctttaaaattttcaccgacaaccacagaagaagcgtttacagtttcagatttaggagatgggctgagatctattttttatttttcacttgttgattcgatacttgatattgagttagaaattactaaagaccgtgaagaaaatcctgataatccaagatttaagctgataccaccaatactgactatcttagctatagaggagccggaaaatcatattgctccacatcatattggaaaactgataaaaaggtttaaacaattaggcaataatgacaactctcaagtaattttaacttcacattctccagctattgtaaaaagaattgacccagaagatttgaggtatttaagaattgaaaataatgacagtgttcttcaaactattgtttctgatatacagttacctcaatcgattgatgagtcttataaatacattaagggagcaattcaagcctatcctgaactatattttgcgaagttagtagtactgggtgaaggtgatagtgaggaactgctattaccaaagttttttgatttacttggaaaagagattgatagctctcagatttcaattgtccctctagggggcagacatgttaactatttttggaaattattgaattcactcaaaattccttatattaccttattggattttgataatgaaagatacgggggtggttggggaagaataaaatatgctatccaacagttactagaaataggtattgagcgtagtgatttagtgacaatggaagatggtagaatattgaatgatgaagacattgctagaattagttccaatcagatatctgatatcttcttaaaaccattgtcatcctggataaaccatttagaaaaattcaatgttttcttttctgcaccacttgatattgatttcctaatgttacagtattataaggactattacctggggactttatctaccaatgaaggacctgtggtttcttatactgatgaaaataatgacaagaaaaaaataagattaactaaaatggacagaacaaatgattatcaattaattggttttaaaaatcgcatcagtgaagctatacaagcaactctaaaagataagagtggacccggtgatagttttactgatgaagaaaaagaactaatgatttggtatcaatatttctttttaggtagaggaaagccgacaactcatatgcaatttttatcatcaattagtgatgatgaattaaagagaaacctacctcctgtgtttgaaaaaatagttagacgtgcggaagaattacttggagatattgactatggtgaagagtgacgattggtttcctaaaggagtcattaaattagaggatgctgctttagaagtagttaaagatgttactaacagtctagtcattgctggaccaggtgctggaaaaacagaattactggctcaaaagttagactatcttttttctacaaataaatgtatttctccaaaaaagattttagctttaagttttaaaacagatgctgctgcaaatttgaaagatagagttaaaaaacgttatggtgatgaatatgcttctcgttttacctcattaacctattcggcttttgaaaagagaattttagaccaatttagagatgttctacctgaggatatacgaccatcaagagattatttgattgaagattgggatactataaaagaactactctctatgaatggaattaatgttaatggatggaggatgtcagatataagaaattttgtcgaaaatattatacttaatgacgggaatactcacaaattaaaaaaggatttactaaaaggaacacaagataataagccggtcctcttgtataggcaaataacaaagttgagtactcaaataatagctactaacgaatacatccgtaaagcacttcaaatgacatacgattttgtatttctagatgaatttcaggatactacatatgcccagtataatttattaaaaacttgttttttaggttcgtcttgtaaattaacagcagttggagataataagcaagccattatgagatgggcaggtgcaaaacctgatatttttccagactatattcgagactttaattcaaatgaatatcaattgttgatgaatcaccgctctgtacctaaacttgtaaaatttcaaaaagaggttcatcagatattaaatagtaatcacagttctattcagccaaataattatccagaatttcaagagggtgaaataacattatttgaatttgaaaatgaaagtttagaagctgagttaattgcaaatgatatagaatcaaaaattcaaggaggtatacgaccatcagaaatctgtatcctagcaaaacagaaggttgatgattatagttcaaaattgataactacattaaacagtaaagggattaaagcaagaattgaaaatgaatatcaagagcttttaaaagaccctacttgtaacctattattagatttaatatcatgcagtcaaggaaaacgagatcctttaatttgggaaaatattagtaatttttatggaaatatcaatggaatagatgagtttactgatgaattaattttagcaaaatcctataaggagattgacaatatagttagtgatattacttacctaatttcaaattttattcccaatgaagaaagtatgctaaatttaattgattgtattattgaaaaaatagatgaaaaaagaattatttccaacttttcaacatacaatggaaaaagtgacctagatatcattgtcaagaatttttcaatgttattatacaaagaatattctcaaacacaaggtgaatggctagatatagtatctagtttcaagggtgaaaactcaatttcaattatgactatccataagagtaaaggattagaatatgaggcagtctattttctaggcttggaggattctgcattctggaattttaataatcaacctgaagaagataaaagtgcgttcttcgttgcactttcacgagcaaaaagtcacctaatcttcacatactgtaaattgagaaataatagggcacaaaacaatagaaatattaatgagatatattcattgctaacccagtctaaactagtaaaggttggtaattaataatgattaaggcataggaatttgttttttaaataaactaattcctatgccttatattgcatgtttgagtagttgaaaatgtgatagtagattatcaagatatacttttttgaaaactttttaataacttaattaagtttagttcagttaagtttttttcattttctttattattatagtcaggatttttttgtttcccctttttaaagtacaaattcaaatctttttttgaaacgactagttgcttcattatctcttctgttgaaaaattactttttattaagttgtgagtcttttctaattctattttatcatcataaattactatattatttttaaatctatataaaggatatttttcgagaccagatattgaagaaaaaactttcagcaattggtattttaaagtattttaaactaaaaatagcataaaaatctagttatccgcataaaaactggacttatcacactttatcaaggtcaaaaccactcaatttactactaatttactacttatgaatgagctttgatacgacgatttatccttgaaaagtgaagatataaagatacttccaataaaatttgaatatttaataggtagacacttcaaaaaatgaggtgtctatttttttacccgattttgaaaggaagtgaacttatgaaaacaaaaaatcaagaatcaaaaggtcgttccccactctttaagaccatcaaacattcattcagccaataaaaaagaaaggataggtaaaaatatggaacttaaatttgtgattcccaacatggaaaaaacattcggcaatttagaatttgctggcgaggataaagtcgttcagcgaagaatcaacggacggctaactgtcttatcaagaagctataatctctattctgatgttcaaagagcagatgatattgtggtggtgcttcctgctgaagctggcgaaaaacatttcggctttgaggaacgtgtgaagttagtcaatccacgtattaccgcagagggctacaaaatcggcactcgtggttttacaaattaccttttacatgctgacgacatggtaaaagaataaagaaagagaggaaaaatgatgagattagcaaatggcattgtattagataaagacacgacttttggagaattgaaattctctgctctacgtcgtgaagtgagaatccaaaatgaagacgggtcggtttcagatgaaatcaaggaacgtacctatgacttaaaatccaaaggacaaggacgcatgattcaagtaagtattcctgccagcgtgcctttgaaagagtttgattataacgcacgggtggaacttatcaatcccattgcggacaccgttgctactgccacctatcaaggagcagatgttgactggtatatcaaggcagacgatattgtgctgacaaaggattctagttcattcaaagctcaaccacaagcaaagaaagaaccgacacaagacaaatagtcgctaggtagaaaggagactttttcgcatgaaacagcgtggtaaaaggattcgcccatctggtaaagatttagtctttcattttacgatagcgtcactcctgcctgttttcctgctggttgtcggactgtttcatgtgaagacaatccagcagatcaactggcaggattttaacctatcacaagcagataagattgacattccctatttaattatcagtttcagtgtcgcaattcttatctgcttgctggtagcgtttttcaaacgggttcgctatgatacggttaaacaactttaccaccgtcaaaaactggcaaagatgatacttgaaaacaagtggtatgaatctgaacaggtcaaaacagagggtttctttaaagatagtgctggtcgtacaaaggaaaagataacctacttccctaaaatgtattatcgacttaaaaatggcttgatacagatacgggtggaaatcacgctgggaaaatatcaagaccaactcttacacttggaaaagaaattagagagtggcttgtactgtgagctgacggataaagagttaaaggattcctatgtggaatatactttgctctatgacaccatagccagtcgtatttctattgatgaagtagaagctaaagatggtaaacttcgcttaatgaaaaacgtatggtgggaatatgataagctccctcatatgttgattgctggtggtacaggtggcggtaaaacttactttatactgacactgattgaagccttgcttcatacagattcaaaactgtatattcttgacccgaaaaatgctgatcttgcggacttaggttctgtgatggcaaatgtctactatagaaaagaagacttgctttcttgcattgaaacattctatgaagaaatgatgaaacatagtgaggaaatgaagcagttgaagaactataagactggcaaaaattatgcttacttaggtctcccggcacacttcttaatctttgatgaatacgtcgctttcatggaaatgctgggaacaaaagaaaacaccgcagttatgaataagctgaaacagattgtcatgttaggtcgtcaagctggcttctttctaatactggcttgtcaacgtccagacgcaaaatatttaggcgacggaatccgtgatcagtttaatttcagagtggctttaggtcgtatgtctgaaatgggctatggcatgatgtttggcagtgacgtacaaaaggatttcttcttaaagcgaatcaaaggtcgtggctatgttgatgtaggaacaagtgtcatatcagagttttatactccccttgtaccaaaaggatatgatttcttggaggaaattaaaaagttatccaacagcagacagtccacgcaggcgacgtgcgaagcggaagtcgcaggtgtggactgatcttgctggctggtgtggcaatagccacgccagcacttaaccccccgtatctaacagggggggtacaaatcgacaggaaacagtcaaaaaaacattagaaaatcctttggttacaagggatttacaaaatttcagcgtatgtcaaatgggctttaaaagttgacatacgcctttttgattggagggatttttactgaatgaacaaacttggttacagcatttaaaagaaaaacgcttggcttatggactatctcaaaaccgtttagctgttgcgactggtattacaaggcagtatctaagcgatattgaaacaggaaaagtcaagccatcagaggatttacagcagtccctttgggaagctctggaacgcttcaatcccgacgctccccttgaaatgctgtttgattatgtaagaattcgctttccgacaacagacgtacagcaggtggtcgaaaacatcttacaactgaaactgtcctattttcttcatgaggactatggtttctattcttattcagagcattatgctttaggcgacatattcgtcctttgctcccatgaactggacaaaggagttctggtggaattgaaaggtcgtgggtgcagacaatttgaaagctatcttctggcacaacaaagaagctggtatgagttctttatggacgttttggtggctggcggtgtgatgaaacgccttgaccttgccattaacgataagacagggattttaaatatccctgtactcactgaaaagtgccaacaggaagaatgtatctccgtcttccgcagttttaaaagctatcgcagtggcgaactggtacgcaaagaggaaaaggaatgtatgggaaacaccctctatatcggttcattacaaagtgaagtttatttctgtatctatgaaaaggactacgagcagtacaagaaaaatgatattcccattgaagacgcagaagtaaaaaaccgttttgagattcgattgaaaaatgagcgtgcctattatgcagtccgtgatttactcgtctatgacaatccagagcataccgcctttaaaattatcaatcggtatatccgttttgtagataaagacgattccaaacctcgttctgattggaaactgaatgaagaatgggcttggtttattgggaacaatcgtgaacgattaaaactaaccacaaaaccagagccttactccttccaaaggacgctgaactggctatctcatcaagttgccccgaccttaaaggttgcgattaaacttgatgaaatcaaccagacgcaggttgtaaaagacattctcgaccatgcgaaactgacagaccgacacaagcagattttgaagcaacagtcagtaaaagaacaggacgtgataacaacaaaaaaataactcaaatacaaattcattgaatatagagaggagaacatttttatgaattttggacaaaacctttataactggtttctatcaaacgctcaatcactggtgcttttagcaatcgttgtgattggcttgtatcttggcttcaagcgtgagtttagcaaactgattggctttttaattattgcgattattgcggttggcttagtcttcaacgctgctggagtaaaagacattttactagagctattcaatcgcattattggtgcttaaataaaaccgttcttttgtggaatataagtggttttcttatgttccgcaaaggaatggtacaccaaacgaagtgcggtagggatttttgaatctctacaaagaaaggacgtgaatatatggacgatatgcaagtctatattgcgaatttaggcaaatacaatgagggcgaattggtcggtgcgtggtttacctttcccattgactttgaggaagtcaaagagaaaatcggcttgaatgatgaatatgaggaatacgccattcatgactacgagttaccctttacggtagacgaatacacttccattggcgaactcaatcgactatgggaaatggtatcggaattacccgaagaattacaatcggagctatctgctctgctcactcatttttcaagcattgaagaactaagcgaacatcaagaggatattatcattcattccgattgtgatgatatgtatgacgtggcacgctactacattgaagaaacgggtgctttaggcgaagtaccagctagtcttcaaaactatattgattatcaagcctatggtcgggatttagacctttcaggaacgtttatctcaaccaatcatgggatttttgaaatcgtctattaaatctgtcggtacattactactggcagattttctattttacggggtggctcaatcagctacccctattttttatgaaaggattgattacatgaagaaaatacgaagctataccagtatctggtctgtggaaaaggtactgtattctatcaatgattttagacttccgtttcccataacctttacgcaaatgacatggtttgtcgtgtcactctttgcagtgatgatacttggcaacttgccccctctttccatgatagagggagcatttctcaaatactttgggattcctgtggctttcacatggtttatgtctacaaaaacttttgatggtaaaaagccttatggatttttgaagtctgtcattgcttatgcactgcgaccaaagctgacctatgcaggaaaaaaagtaacgcttggcagaaaccagccacaagaagccattacagcagttaggagtgaattttatggcatatccaattaaatacattgaaaacaatctcgtctggaataaagacggggaatgttatgcttactatgagcttgttccttacaattactcatttctaagtccagaacagaaaatacaagtgcatgattctttcagacagcttatcgcacaaaatcgtgatggcaaaattcatgctttacaaatcagtacagaatccagcatacgttctgcacaagagcgttccaaaaatgaagtcactggcaagctcaaagcggttgcctatgacaaaatcgaccaacagacagacgctttaatatccatgattggcgaaaatcaagtgaactaccgtttctttatcggctttaagttgcttctcaacgatcaggagttttctatgaaaagtcttaccgttgaagcaaaaaatgctttgtctgattttgtctatgatgtgaaccataagctgatgggcgattttgttagtatgagtaatgatgaaatcctgcgttttcagaagatggaaaagctcttagaaaataaaatctctcgtcgtttcaaaatccgcaggttagataaggacgacttcggctatctgattgaacacctttacggacagacaggcactgcctatgaagagtatgagtaccatctatcaaagaaaaagctggataatgaaacgctgattaaatactatgacttgattaagcctactcgctgtttggtggaagaaaaacagcgatatttgaaaatccagcaggaagatgaaaccgtctatgtagcttactttaccattaacagcattgtcggagaactggacttcccgtcctctgaaatcttctactaccagcaacagcaatttacattcccgattgatacgtcaatgaatgtggaaattgtagcgaatcgtaaagccctatctactgtccgcaataaaaagaaagaactgaaagacttggataaccacgcttggcaaagtgataatgaaaccagctccaatgtggcggaagctctggaaagtgtgaatgagctggaaaccaatttagaccaaagcaaggaatctatgtacaagctgtcttatgtggtaagggtatcagcaaatgatcttgacgaactcaaacgtcgttgtaatgaagtgaaagatttttatgacgatttaagcgtaaaactggtacgaccatttggggatatgctcggcttacatgaagaatttttacctgccagcaagcgttatatgaatgattatattcaatacgtgacctctgatttcctcgctggtttaggttttggtgctactcaaatgctgggggaaaatgaggggatttatgttggctacagcttagatactggacgcaatgtctatctgaaacctgctcttgccagtcaaggggttaagggttcagtaaccaatgcgttagcgtcggcttttgttggttcgctgggtggtggtaaatcctttgcgaataaccttatcgtctattatgcggtgctttatggggcacaagcagtgattgtagacccaaaagcagaacgtggcagatggaaagaaaccttgccagagatttcccatgaaatcaatatcgtcactctgacttctgatgagaaaaacaaaggcttacttgacccttatgtgattatgaaaaatcccaaagattctgaatcactggctattgatattctgacattccttacggggatttcctctcgtgatggggaacgcttcccaatccttagaaaagccattcgtgcagtaaccaatagtgaagtacgagggttgatgaaagtgattgaggaattacgggttgagaatacgccactaagtaccagtatagccgaccatatcgaaagttttacagactatgactttgcacatttattattcagtaatggttatgtggagcagtctatcagcttagaaaaacaactgaacattatacaggttgcggacttggtacttcccgacaaggaaacttcctttgaggaatataccactatggagcttttatccgttgctatgctgattgtcattagtacctttgctttagactttatccatacagaccgaagcattttcaagattgtagatttagacgaagcatggagctttttacaggtagcacaaggaaaaacactatctatgaagctggttcgggctggtcgtgctatgaacgctggggtatatttcgtgacccaaaatacagacgacctcttagatgaaaaactgaaaaataacctcggcttaaaatttgcatttcgttccactgaccttaacgagattaaaaagaccttagccttttttggtgtagacccagaggacgaaaacaatcagaagcgattgcgtgatttggaaaacgggcaatgccttatcagtgatttatatggtcgtgtcggtgtgatacagttccaccctgtatttgaagaactgctccatgcctttgataccagaccacctgtgcgaaaagaggtgtaaatgtgaaaccatcaatagtaaacagaataaaatcaaactggacgctgaaacgtctaggtaaagtggcaatgacagtggctttcacacttgtgattgccatttttcttttagccatgctgggaacggtggttcaagctgcgggcttggtagatgatacggtcaatgtggcaaatgaatacagccgatacccacttgaaaactatcaactggatttttatgtggataatagctggggctggcttccgtggaactggtcggacgggattggaaaacaggtcatgtatggactatatgccattaccaattttatttggacaatcagtttgtatgtttccaatgcgacaggttacttagtacaggaagcctattccttagacttcatttccgctacagcagattccattggtaagaatatgcagaccttagctggtgtgagtgcaaacggattttcaacagagggtttctatgttggattcctcttactcttgattttggttcttggggtttatgttgcctatacgggactgataaagagagaaaccacaaaggcaattcatgccattatgaattttgtgctggtgtttatcctatcggcttcctttattgcctacgctcccgactacattaaaaaaatcaatgacttttcatcagacatcagtaatgccagtttatcacttggcacgaagattgtcatgccccattccgatagtcaaggcaaggacagcgtggacttaatcagagatagcctgttttccatacaggttcagcaaccgtggctactgcttcaatacaacagttcagacattgaaagtatcggtattgaccgtgtggaaagcctctccaccagcccagattccaacaatggcgaagacagagaaaaaattgttgcggaagaaattgaagacagaagcaataccaatctaaccattacaaagaccattaaccgtttaggtacagtcttcttcctatttgtcttcaatattgggatttccatatttgtattcctattaacaggaatcatgattttctcgcaggtactttttatcatctatgctatgtttctgcctgtgagctttattttaagcatgattccatcatttgatggtatgtcaaaacgagccataacaaagctctttaataccattttgacacgagctggaatcacattgattattacgacagcatttagtatttcaaccatgctctataccttatcggctggttatccgttctttttgattgcttttctacagattgtgacctttgcaggaatctacttcaagctgggcgatttaatgagtatgttttctctacagagtaacgattctcaaagtgtgggaagtcgtgtgatgagaaaacctcgtatgcttatgcacgctcacatgcaccgtctacagcggaaacttggacgttccatgactactctaggggctgggtctgccattgttacaggtaaaaaaggacagtcgggttcggggagttctgcaaggacacaagcagatcactcccgaccagacggaaaggaaaaatcaacacttggaaaacgtatcggtcaaaccatcggtacagtagctgataccaaagacagaatggtagacactgctagtggtttgaaagaacaggttaaagatttgccgaccaatgcaagatatgcagtatatcaaggaaaatccaaagtaaaagagaatgtccgtgatttaaccagtagtatttctcaaaccaaagcggacagagccagtggacgcaaggaacagcaggaacaaaggcgaaaaaccattgcgaagcgtcgctctgaaatggaacaggtcaaacagaaaggctatgttagctaacttcgtgattaatcctatctaaaataggctataatatagatataaactatatttcaactaatttgtagaaaggatacctaatattatgccaaaaacaaatataaaagctatgataaaagatttaaaaaagaatgaacttatagaattaatttcggtagcacaggaagtattaagtagtttatttaattcttctgaaattagagataatgttaaagaaagtagattttccaagggatacgaatgcccaaaatgtcaatgtaaagatgtaaataaaaacgggaagtctaacggaagacaaagatatatctgtaaacgttgtcgtacaagttttgatgagtttactatgtctccattctctaatacaaaattagacttagataaatggctaaaatactgcgaattaatgatattaggactttctataagaaaatgtgctgaagaagtcggtgtaggtgttaaaacatctttttacatgcgtcataggatacttgatgtaatcaatctatcattaaaaaatgataaagttgaaggtatagtagaagtagatgaatgctttattaaggagtcttttaaagggaatcactctaaaagtactacatttgtaatgcctagaaaccctagaaaaagaggtaaaggtaaaaatgataagaataaaagaggaatatcaaaagagcagatttgtatagagacagcaattgatagaaaaggaaatatccttatgggtgcggtttgtaatggtagaattacaacgaatcaaatagttaacttctttgacaataaaatatgcgaagaggctactttttgcgtagattcacataaatcatatgtaggaataaaggacaagttgaatatagaattaaagcaagttcctagaggaaaatcaatgatagatagtgtttatcatttacagcatataaatgctcttcacagtagctttaagagatggttaatgacttttaatggtgtatccacaaaatatatcaataattatttggcttggtttaaatttctacaactaagtaagaagaataagaagaatgaccgaattaaagatatgctagtgaatgtagctactaaggatacatatgtaactagagccactattagaaatagattcattgagttaacctaaaataaggaactttacttcaaattaatgaaactattttataattgaaaaataataggatattttgtataatataatcaagttcgcaattgttatataatgcgaaagataaatagaaatttgaaagagagagataaaaatgaaatttaccgttattgataaagaaaactgggatagaaaagaatactttgagcattatttttctggagttccatgcacatatagtatgagtgtaaagttggatattacggaaataaaaaatagaaaaaagaaattatatccaacaatgttatattttattactactattgttaatagacatgatgagtttagaacttcatttaatgcagaggggcaattaggtgtgtatgatgaaatgatacctttctatacaatatttcataaaaatacggaaactttttccaatctttggaccgagtattttaacaagtatgatgatttctgtgccgcttatgaaaaagatatggaagaattcggagaactaaaaggaatgatggtaaagccgaatattcctgaaaataattttccagtatcaatgattccatggacaacatttgaaggttttaacttaaaccttcaaaaaggatatgagtatttgttacctatatttacaatgggaaaatattatgaagaaagaggaagatatattttgccattagccattcaagtacatcatgcggtatgtgatggatttcatgtatgtcgttttgtaaatgagttgcaagatttaatcaatggataaattcaatttgtagagctgattaagtgaacaattttaatatattacgaacaatttatagtaagttatagaagcaaccacatcttagaattcaatatattgaaaagtctaaggtgtggttgtttttatgctatatttatcacgaagaaggctaacatagccaacagaaaaaacagcctgcttcttctgttcatgaaagaccgactacaagacaagaacaatatcatgatgaacagacctcaaaacagtctaatattcagacttcatataaggaatctcaacaagccaaacaagagcgtccagcagttaagtccgatttttcaagtccaaaagtggaacgccaaggcaataccgttcaagaaaaaaccgttcaaaagccagcaacttcaaccactacagcagatagaacttcacaacgtccaatcacaaaagaacgtccgtctactgttcaaagagtaccactacaaaatacaagaagtagaccaccaatcaaaaccgccaccattaagaaagtcggtaagaaaccatgaagttgaaaactttagtgattggtggttctggattattcttgatggtcttctcactgcttctgtttgttgccattttattttcagatgaacaggacagcggaatttccaatattcattatggaggtgtgaatgtttccgcagaagtgctggctcataagcctatggtagaaaaatatgccaaagaatatggcgttgaagaatatgtcaacatacttcttgcgattatacaggtggaatcgggcggtactgcggaagatgttatgcagtcctcggaatccctcggtcttccacctaattcattgagtacagaagaatccattaagcaaggtgtgaagtatttcagtgaattattagccagtagcgaaaggctcagtgtagatttagaatcggttatccagtcctacaattatggtggtggtttcttagggtatgtggctaatcgtggaaataaatatacctttgaactggctcaaagtttctcaaaagagtattcaggtggcgaaaaagtgtcttaccccaatcccatagccatacctatcaatgggggctggcgatacaactatggcaatatgttttatgtgcaactggtaacgcagtatcttgtcacaacagagtttgatgatgatacggtacaagccatcatggacgaagcactgaaatatgagggctggcgatacgtttacggtggagcttccccgactacttcttttgattgtagcggactgacacaatggacgtatggaaaagctggaattaacttaccacgaaccgcacaacagcaatatgatgtgacccagcatatcccactatcggaagcacaagctggcgatttggttttctttcattctacctataacgctggctcttatattactcatgttgggatataccttggcaataaccgtatgtttcatgcaggcgacccaatcggttatgccgacttaacaagcccctactggcaacagcatttagtgggagcaggacgaatcaaacaatgagaaaggaagatttaatgatgaaatttagaaaaaatcagaataaagaaaaacagataccaaaggaaaagaaacctcgtgtctataaggtcaatcctcataaaaaggttgtgattgccttgtgggtacttttagggcttagtttcagctttgcgatattcaagcactttacagctatagatactcatactattcacgaaacaactatcatagaaaaggaatacgttgatactcatcatgtagaaaattttgtagagaactttgcgaaagtctactattcatgggagcaatccgataagtccattgataatcgaatggaaagtctaaaaggctatctgacagatgaacttcaagctctcaatgttgatacagtacgcaaagatattcctgtatcgtcttctgtaagaggatttctgatatggacggtagagccaactggcgacaatgagtttaatgtaacctacagtgtagaccagctcattacagagggagaaaatacaaagaccgtccactctgcttatatagtgagtgtctatgtagatggttctggaaatatggtactggttaagaatccgaccattaccaacatacctaagaaatcaagttataaaccaaaagccattgaaagtgaggggacggttgattccattacaaccaatgaaatcaatgagtttttaacgacgttcttcaagctctatcctacagcgacagccagtgaactttcctactatgtgaatgacgggatattaaaaccaatcggaaaagagtacatctttcaagaactggtaaatcctattcacaatcgtaaggataatcaagtcacggtatcgctgacagtggagtatatcgaccagcagaccaaagcaacgcaggtatctcaatttgatttggtacttgaaaagaacgggagtaattggaagattatagaataacaaatattggtacattattacagctattttgtaatcacgtactctctttgataaaaaattggagattcctttacaaatatgctcttacgtgctattatttaagtatctatttaaaaggagttaataaatatgcggcaaggtattattaaataaactgtcaatttgatagcgggaacaaataattggatgtccttttttaggagggcttagttttttgtacccagtttaagaatacctttatcatgtgattctaaagtatccggagaatatctgtatgctttgtatgcctatggttatgcataaaaatcccagtgataagagtatttatcactgggatttttatgcccttttgggcttttgaatggaggaaaatcacatgaaaattattaatattggagttttagctcatgttgatgcaggaaaaactaccttaacagaaagcttattatataacagtggagcgattacagaattaggaagcgtggacaaaggtacaacgaggacggataatacgcttttagaacgtcagagaggaattacaattcagacaggaataacctcttttcagtgggaaaatacgaaggtgaacatcatagacacgccaggacatatggatttcttagcagaagtatatcgttcattatcagttttagatggggcaattctactgatttctgcaaaagatggcgtacaagcacaaactcgtatattatttcatgcacttaggaaaatggggattcccacaatcttttttatcaataagattgaccaaaatggaattgatttatcaacggtttatcaggatattaaagagaaactttctatggaaattataatcaaacagaaagtagagctgcaccctaatatgtgtgtgatgagctgtacggaacctgagcaatgggatgtggtaatagaaggaaatgatgaccttttagagaaatatatgtccggtaaatcattagaagcattagaactcgaacaagaggaaatcagaagatttcagaattgctccttgtaccctgtttatcatggaagcgcaaaaagcaacatagggattgagcagcttatagaagtgataacgaataaattttattcatcaacatacagaaagaagtctgaactttgcggaaatgtcttcaaaattgaatattcggaagaaagacaacgtcttgcatatgtacgcctttatggcggaatcctgcatttgcgggattcggttagaatatcggaaaaggaaaaaataaaaattacagaaatgtatacttcaataaatggtgaattatgtaaaattgataaggcttattccggggaaattgttattttgcaaaatgagtttttgaagctaaatagtgttcttggagatacaaagctattgccacagagagagagaattgaaaatccgctccctctgctgcaaacaactgttgaaccgagcaaacctcaacaaagggaaatgttacttgatgcacttttagaaatctccgacagtgacccgcttctacaatattatgtggattctacgacacatgaaattatactttctttcttagggaaagtacaaatggaagtgattagtgcactgttgcaagaaaagtatcatgtggagatagaactaaaagagcctacagtcatttatatggagagaccgttaaaaaatgcagaatataccattcacatcgaagtgccgccaaatcctttctgggcttccattggtttatctgtatcaccgcttccgttgggaagtggaatgcagtatgagagctcggtttctcttggatacttaaatcaatcatttcaaaatgcagttatggaagggatacgctatggttgcgaacaaggattatatggttggaatgtgacggattgtaaaatctgttttaagtatggcttatactatagccctgttagtaccccagcagattttcggatgcttgctcctattgtattggaacaagtcttaaaaaaagctggaacagaattgttagagccatatcttagttttaaaatttatgcgccacgggaatatctttcacgagcatacaacgatgctcctaaatattgtgcgaacatcgtagacactcaattgaaaaataatgaggtcattcttagtggagaaatccctgctcggtgtattcaagaatatcgtaatgatttaactttctttacaaatggacgtagcgtttgtttaacagagttaaaaggatatcaggttaccactggcgaacctgtttgccagccccgtcgtccaaatagtcggatagataaagtacgatatatgttcaataaaataacttagtgtattttatgttgttatataaatatggtttcttgttaaataagatgaaatattttttaataaagatttgaattaaagtgtaaaggaggaattaattatgaagtgaaatgaatgtaacagggttcaattaaaagagggaagcgtatcattaaccctataaactacgtctgccctcattattggaggttgaaatatgaatacatcctattcacaatcgaatttacgacacaaccaaattttaatttggctttgcattttatctttttttagcgtattaaatgaaatggttttgaacgtctcattacctgatattgcaaatgattttaataaaccacctgcgagtacaaactgggtgaacacagcctttatgttaaccttttccattggaacagctgtatatggaaagctatctgatcaattaggcatcaaaaggttactcctatttggaattataataaattgtttcgggtcgttaattgggtttgttggccattctttcttttccttacttattatggctcgttttattcaaggggctggtgcagctgcatttccagcactcgtaatggttgtagttgcgcgctatattccaaaggaaaataggggtaaagcatttggtcttattggatcgatagtagccatgggagaaggagtcggtccagcgattggtggaatgatagcccattatattcattggtcctatcttctactcattcctatgataacaattatcactgttccgtttcttatgaaattattaaagaaagaagtaaggataaaaggtcattttgatatcaaaggaattatactaatgtctgtaggcattgtattttttatgttgtttacaacatcatatagcatttcttttcttatcgttagcgtgctgtcattcctgatatttgtaaaacatatcaggaaagtaacagatccttttgttgatcccggattagggaaaaatataccttttatgattggagttctttgtgggggaattatatttggaacagtagcagggtttgtctctatggttccttatatgatgaaagatgttcaccagctaagtactgccgaaatcggaagtgtaattattttccctggaacaatgagtgtcattattttcggctacattggtgggatacttgttgatagaagaggtcctttatacgtgttaaacatcggagttacatttctttctgttagctttttaactgcttcctttcttttagaaacaacatcatggttcatgacaattataatcgtatttgttttaggtgggctttcgttcaccaaaacagttatatcaacaattgtttcaagtagcttgaaacagcaggaagctggtgctggaatgagtttgcttaactttaccagctttttatcagagggaacaggtattgcaattgtaggtggtttattatccatacccttacttgatcaaaggttgttacctatggaagttgatcagtcaacttatctgtatagtaatttgttattacttttttcaggaatcattgtcattagttggctggttaccttgaatgtatataaacattctcaaagggatttctaaatcgttaagggatcaactttgggagagagttcaaaattgatcctttttttataacaggaattcaaatctttttgttccattaaagggcgcgattgctgaataaaagatacgagagacctctcttgtatcttttttattttgagtggttttgtccgttacactagaaaaccgaaagacaataaaaattttattcttgctgagtctggctttcggtaagctagacaaaacggacaaaataaaaattggcaagggtttaaaggtggagattttttgagtgatcttctcaaaaaatactacctgtcccttgctgatttttaaacgagcacgagagcaaaacccccctttgctgaggtggcagagggcaggtttttttgtttcttttttctcgtaaaaaaaagaaaggtcttaaaggttttatggttttggtcggcactgccgacagcctcgcagagcacacactttatgaatataaagtatagtgtgttatactttacttggaagtggttgccggaaagagcgaaaatgcctcacatttgtgccacctaaaaaggagcgatttacatatgagttatgcagtttgtagaatgcaaaaagtgaaatcagctggactaaaaggcatgcaatttcataatcaaagagagcgaaaaagtagaacgaatgatgatattgaccatgagcgaacacgtgaaaattatgatttgaaaaatgataaaaatattgattacaacgaacgtgtcaaagaaattattgaatcacaaaaaacaggtacaagaaaaacgaggaaagatgctgttcttgtaaatgagttgctagtaacatctgaccgagatttttttgagcaactggatccaggagaacaaaaacgattttttgaggaaagttataaattattttccgaacgatatggcaagcaaaatattgcttatgcaacagttcataatgatgagcaaacccctcacatgcatttaggtgttgtgcctatgcgtgatggaaaactgcaaggaaaaaatgtgtttaatcgtcaagaactgttatggctacaagataaattccccgagcatatgaaaaaacagggttttgagttgaagcgtggtgaacgtggctctgaccgtaaacatattgagacagctaaatttaaaaaacaaactttggaaaaagagattgattttctagaaaaaaatttagcagttaaaaaagatgaatggactgcttatagcgataaagttaaatcagatttagaagtaccagcgaaacgacacatgaaaagtgttgaagtgccaacgggtgaaaagtccatgtttggtttgggaaaagaaataatgaaaacagaaaagaaaccaaccaaaaatgttgttatatcggagcgtgattataaaaacttagtgactgctgcgagagataacgataggttaaaacagcatgttagaaatctcatgagtactgatatggcgagagaatataaaaaattaagtaaagaacatgggcaagttaaagaaaaatatagtggtcttgtagagcgatttaatgaaaatgtaaatgattataatgagttgcttgaagaaaacaagtctttaaagtctaaaataagcgatttaaagcgtgatgtgagtttaatctatgaaagcactaaggaattccttaaggaacgtacagacggcttaaaagcctttaaaaacgtttttaaggggtttgtagacaaggtaaaggataaaacagcacaattccaagaaaaacacgatttagaacctaaaaagaacgaatttgaactaactcataaccgagaggtaaaaaaagaacgaagtcgagatcagggaatgagtttataaaataaaaaaagcacctgaaaaggtgtctttttttgatggttttgaacttgttctttcttatcttgatacatatagaaataacgtcatttttattttaatacatatagaaataacgtcatttttattttagttgctgaaaggtgcgttgaagtgttggtatgtatgtgttttaaagtattgaaaacccttaaaattggttgcacagaaaaaccccatctgttaaagttataagtgaccaaacaaataactaaatagatgggggtttattttaatattatagttctttgtctgtaaagctatccatgtatttctctatctgtaatcgtcgggtgctttttaccaagttattagcaggtaagaaaaattcatcaacggaaacatgaagtaacgatacaaggtcataaagaacttgtatgctggggtgttgccctttattttcaatattagttaagtaccgtgggtcaatttcaatcaatgctcccacttgttcacgagttaaacctcgtttcaatcgagcttctttaatggctaaaccaaaggctctaaaatcatatttatcttcttttttacgcatagtagaccacctctatacattttattgttcctactgaattaaaaacaggtatagaaaaacgtgttatatggtttataggtttatatttaataaaaagcactactaaacgccaataaaaaaaaccgttatatggtagtgctatttacgctgttaaaatattgtatattacttccaaatggcggtttgttggaggtcaacgtcgccatgaagtacatcatatacaataaatttccttacattgggttcttgtcaaaaaaagtcgtctatctgcaatagataagtacgtccaccaatgtggttttataaatcatatagatagaataacagaagcatgtaaacagagaaataaatctgtttatatgcttttttggctattcagaacttttttacaaagtttatttatcagtaatgcaacaaatccccctttcacattgggactaagagtgaaaggagataaacgagcaaggctcacttcctttcctagacagaaagggggtgagaaacatgaaaccatcttcttttcagaccacaatagaaaatcagtttgactatatctgtaaacgtgctatggaagacgagcgaaagaattatatgctttacctttcaaggattgcaaagcgtgaggtgtccttttcggatgttggcgattatcttgttagccagtttgcgacaacagataactattcaactgactttcagatttttacactcaatgggttatcagtaggcgttgaaaatgatttgttgagtgaagcattacgtgagttgccagacaagaaacgtgaaattctactgctgttttactttatggacatgagcgattcagaaattgcagacctgttgaaattgaaccgttctactgtctatcggcatagaaccagtggactagccttaattaaaaagtttatggaggaatttgaagaatgaaaacacaatatcctatgattccctttcctctcattgtaaaggcaacagatggcgataccgaagcgattaaccagattctacatcattacagagggtacataacgaagcgttccctacgacttatgaaagatgaatatggcaatcaaagtatggtcgttgatgaagtcttacgtggaagaatggaaaccagactgattacaaagattttgtcatttgaaattaagtaatatcctctctcctttcgtggaagcgtgctaaaccattccacgcttcccgaacagggaggtttgttattccaccaaagcatattgagctttcaatgtgttttgataggctaacgagccattgttctttgaaaactgaataaaagtaatcgaatacgtttcgataagaaaagagccaacggaactaaccgccatgacctatcttataaagatagcgagcgattcatgttagtgatccgagaagcaatctttagcaggattgcctgcaacgacattcttatcgtgataatgatactcccatacagtcaatagtccgagcgtgataaaaccgtcgcaggcaatgagtatggctacatgagaaccatgcaggggtggaactcccgtgagctttgctaaagctgttcgattgctggtaaaacaacttttatgaaatccaaataagtgatttggaaaggaggattttatgaagcagactgacattcctatttgggaacgttataccctaaccattgaagaagcgtcaaaatattttcgtattggcgaaaacaagctacgacgcttggcagaggaaaataaaaatgcaaattggctgattatgaatggcaatcgtattcagattaaacgaaaacaatttgaaaaaattatagatacattggacgcaatctagcgtcgccaaagggtcttgtatatgataaaatagtattaagtcgtatcaaggctctttccataaaggaaaggagcaaatgccatgtcagaaaaaagacgtgacaataaaggtcgaatcttaaagactggagagagccaacgaaaagacggaagatacttatacaaatatatagattcatttggagaaccgcaatttgtttactcgtggaaacttgtggctacagaccgagtaccagcaggaaagcgtgattgtatctcacttagagagaaaatcgcagagttacagaaagacattcatgatggtattgatgttgtaggaaagaaaatgacactctgccagctttacgcaaaacagaacgctcaaagaccaaaggttagaaaaaacactgaaactggacgcaaatatcttatggatattttgaagaaagacaagttaggtgtaagaagtattgacagtattaagccatcagacgctaaagaatgggctattagaatgagtgaaaatggttatgcttatcaaaccatcaataactacaaacgttctttaaaggcttcattctatattgctatacaagatgattgtgttcggaagaatccatttgactttcaactgaaagcagttcttgatgatgatactgtccctaagaccgtactaacagaagaacaggaagaaaaactgttagcctttgcaaaagctgataaaacctacagcaaaaattatgatgaaattctgatactcttaaaaacaggtcttcgtatttcagagtttggtggtttgacacttccagatttagattttgagaatcgtcttgtcaatatagaccatcagctattgagagatactgaaattgggtactacattgaaacaccaaagaccaaaagtggcgaacgtcaagttcctatggttgaagaagcctatcaagcatttaagcgagtgttagcgaatcgaaagaatgataagcgtgttgagattgatggatatagtgatttcctctttcttaatagaaagaactatccaaaagtggcaagtgattacaacggcatgatgaaaggtcttgttaagaaatacaataagtataacgaggataaattgccacacatcactccacatagtttgcgacatacattctgtaccaactatgcaaatgcaggaatgaatccaaaggcattacagtacattatgggacatgctaatatagccatgacgctgaactattacgcacatgcaacattcgattctgcaatggcagaaatgaaacgcttgaataaagagaagcaacaggagcgtcttgttgcttagtagtacaaatgaatttactacttatttaccacttctgacagctaagacatgaggaaatatgcaaagaaacgtgaagtatcttcctacagtaaaaatactcgaaagcacatagaataaggctttacgagcatttaagaaaatataaaaagataattagaaatttatactttgttttgtataaacagtggtaataaatagtgtcagaataaccacattcaaaactttctaaatcaggggagggcactagacaatttccctgatctaaatataaagccctaaagtcgataattgtaaggtgtcgataacgaagttgtactaattgccaatcaacattggtttggtattgatttaaactataaggcatagttttgaaacgatttgcatcatcgtcggtaagtttaatataaaaatcgggattaggattataaataaaaaatcttccgtcttcattttcaatgaagaaccaatttttatagtcttttaaaacatgaaaatactgctctttgatatttaagtcggtatgattaaacttttgaaacaacttatttattaactcaaaaggagcagaggagtctttaggagtatttatagagccatttctagcatatattaatccttttggtaatgcagtatctttcttaggcttataatcttttgttaaaaatacaggaactttatcagtatcatgaataattaagatgtcaatttctttgttgtctatagtttcagtttgtatgctaattttaatttgattatttgttgatataaagagtttatgtagtaaatctgttagatcttcttcatttcttctattatcatcattgtttaaaccgattatatctaaagtgatattatcaattccaaagatgatataacaatcttcgtgatgtgatgtattaacaaaattcaagatgtcacgaactaattcagactttgaatgatgccatttttgtttgaaatcatgaagctcatcttcaggagtattaagtagtaaatctaattgttctatattcagcatgactatttctccaaatattcagtttacaggaattgtatcatagaatttaagaaagtcaattataactgtattagttgtgataccttttccaaatcttccttgttatcctaatatcattcttaagaaaataaagacttgattttctactgggggtttgggggcggggccaccaaattatcttatcgttagctgtcaaaactggagagttttagtcagctggcgatatgatttttgggatattgtggacacaatatctgagctcgcaaaagccgaaaagggacaccttgaggcttttctagggcgtactgacagtgtgaggcagcctgacattgttagacaagcagaatggaagggaagtgttaagatgagtcaagacttaaagctaattcgtaagcagtttcgagtgactaagcaggaagaaatattgctaaaagagatgatgaaagagcaaggttcggagactttttcagattttctccgccaaaacttgttacaaaaagaccgccaaaaagacattttggagacctggtcttctctatggcagtctcaaaaattggaagaaatcagccgagacattcatcaagtgactgtccttgcggaggaataccaacaagtcacctctgaacatctacgcattattttgacctgtgtgctggaactgatggcagaagtcgagaagtctatcccgctcagtccagactttcgtgagaagtatataggaggtcgctaatggattatcgctaccgcactaacctcaaaaaagtgtttttgacagatagggaactggctcagcttaatgactgtatttcgcaaagcagatgtaaaactttttcagagtatgccagaaaagtcttacttgatccgaacagaaattttatcacaattgacacgaccacttatcaggatttggtctttgagctgcggcggataggcaacaacgtcaaccagattgcccgtgtcattaaccagactcatctgatttctatggagcagcttcaaggcttaggtcaagggatggcagagctggtatcggaagtggagaaagattttcaaatcaaggctgaacagctaagggatttctatggtcatcactaagcattatgccacacatagtcgaaagtatcgaaagaacctaattcgctacattctcaacccagaaaagacagcccagctcaaattggtttcagattttggcatgagtaattacctggattttcccagttatgaggaaatggtcaagatgtatcaggccaattttttgaataatgacggcttgtacgattccagaaatgacagacaagaaaaacgccaacagaaaattcatgcccaccacctcattcaatccttttcgcctgacgataagttaacacctgaagagatcaatcggattggttatgagactgtcaaagaacttactggcggaaattttcgttttatcgttgcaacccatattgaccagtcacacattcataatcacatcttaatcaattctgttgaccttcaatctgataaaaagctcaagtggaactatgccttggaacgaaatcttcgtatgatttcagaccgcatttccaaagaggctggtgcaaaaattatcacgaatcgctattcacatcagcagtacgacgtttatcgcaagaccaatcataagtttgaactcaagcaacgcctgtattttttgatggaacagtccaaggattttgaggactttttgaaaaaagcagagcagctgcatttgactattgacttctcaagcaagcatactacctttttgatgacggatagagatcaggtcaaacccattcgcgggcgacagcttaatcgcagggaaccttatgatgagagctatttccgacaagcatttgccaagggtgccattgagcaacgattacattttttattgcctagagtgaaaactttacaagaattattggaaatggcagaggaacttggactatttattcaactcaaacagaaaaatgtgacctttacccttacggaaaatgaccagaaaatttctctaggacatcaacaagtgagcaagaaaaagctttatgatgtctctttcttccaagattatttttcagaacggtcagatactgacattgagctgagtgataatatcaaggaagattttgaaatatttctcgcagagcaagcggagaagttatcaacagtagaaagtatcgtctcagactatgaaacgttctccgaaaatcgtaaggctgttcatgagtttgaggtggagcttgccccgcatcaggttgacaaagaagttgagggtggcattttcatcaaggtagcctttggtgtgaaaaaagagggcttgatatttattcccaattatcagctggatgagattgagaaagaggaggaaaagaggtttaagattttccttcgagaaatcacgtcttattttatctacaataaggaaagttcggataagaaccgctatatgaaagggcgtgacttgattcgtcagctgacacaagacaacaaaagcttgccttatcgtaggcgaccaaatctaaaagagttacaggagaaaatcactgaagtcaatctcttgattgaactcaatgttacaaatcgagcttatacggacattaaagatgagttggtggcggaaattgcgacgtacgatgttagcatgtcagaactcaacgaaaaaaccgccaccttaaataagatagcagaagtcttagtcaatctcaaaagtcacgatatagaacgtaggcgattggcacgttatgaattttccaaactcaatctgacagaaagtgtaactttggagcaaatcgaacgagagatttctaacactcaagaccaactcagtaagttacttgacaactatgaagaatccgtcagaaaactggaaacctttgtggcggtgttgaatagaacagctcctagaacaagaaaggattatgataaggaactatactaaaaaaacactcagttgaaatactgagtgttaatcatttatcaggtttgatatgagagtatctagattgtcagggctatgaatttcgaaactttggagattttccttaccagttggagcttgtcgatgtcgatggttaaaccgaacaagaatagtgccataactttatcatttttattttgaaattatccttgatttaagctcgcttaaatcagtaattgtttataaatttgatttttctgaaaaaaatctgaataatctttgctactatttaaatggtcaaacagtctggactattcaatattgacttagaaaggaaagtatatgaattatacgaagccagttatagaaaaaatttctacttttaaaaatggtacagcaggattagttgcaggtagcttcagagatatatttggtggcagggctttatttttaattagaatataatccattacccagatatattcattactcctatgttcagctaaagtacagattactagcgcaaatagctttactaatctcttatccgcttacaaagctctcgcctacaagaattgaatttttgattaataaattaagtgactcaaaattatccgccacagtaaatgaagttgtattagctcgtgatgcaatatgtactgtaagccgtaagtgtaggaatcaagatggatgcgtaaaaagatcattaggagtaataatgttcttacttcttttaaagaaacgtgcaagttggtgtactggatttgctatgaacccctttagatctcatgcatgggtggaagtcaatggaaatccgattaaagagctagaagaagtatcatcgtatgaaagagttgtgaaaactctagatgataaaaatgaagagcgtaaacatatgataactgaagatatagaaaaagtaaatgatactatgactaatgtaaaattccgtgatttacttgccttgatagaaaataaaggaaaatattttttaatcgttttatgtttgggaatacttacgtccattttaacgttattacagccagaacttttgtctaaagtaatctctcaaaagggagtaaatttattcaataattccactatgtatacgcttattgctattaccgtgggtacaactattatttccagtttgcaatattatttcttacaattaatgggagaaagtgcagtatttcaatcaagaaaaaatttaattattcaatttcttaaacttcctatttataaatataatgatctgtcagcaggagacctaattagtcgatttagcagtgatacaagtaagctaagagcgggaatcattcaatcaaccgttgctctgacgagtggattgttcttgagtttaggtgcgatatttacattatttctaaaggatacatatcttgcaataattacaattatttccatatctttatcattcctatttattttattgatgagtagtttgattcaaacagcaagttataaagctcatcagggtttggggaaaatgacagcatacttaaataggctaatcgtaggaattagaacaattcgatcgacaaatgaaacgaattcagaattatctaaaatgttatctgaggcacaagaagtaaaaaacttgggaattggagttgcaagagtgcaatcaataatgacaccgatatcaaattttagcttgcagttgtgtgggataattattttgggagtcggaggataccgtgtttctactgggcaaatgtctattgcaagtctaacttcttttatgctattaatgtatatcgctatttcaccagtaggacaaatattttcatcggtcacaactatttcagaagctttaggagctttaggtagaattactgaaattattgatcttccaaaagaagaagataatgatatcattttaaatctagaaactaagtcggatagaagcaaagcaattgaatttgcgaatgtaactttttcatatgattcttacaaatttcaggatattcaatcggatgataattatatattaaaggacattactttcgaaataaatagtggagattacgtcagtattgtcggtccgtctggtgcggggaaaagcacacttctttatctcatcgaaagattctatgatattactagtggtagtataaaggtatttggacaagatttccgaacaatgagtcgcgagactttacgttctaatatttcttatgttgagcaaaactcaccattagtagctggtacaattttagaaaatctaaaaatgggtaatactaatgtaacatatgatgaatgttgtgacgctttaaaaaaagttggtttagagcatttgattcaaagaggtgcatctggggttgagagtcaaattggtgaaggaggtttcaatttatcaggaggagaaagacagagattggcaatggcaagagcaatactttctgatgcaaagatactcttgctggatgagttaacttcgaatctagatagtcttagtgagaagaagatgaaggaagcaatcaaaaatatgagaggtgagagaaccataataatggttgctcatagattatctacaattttagattcagatgaaatctttgttttggaacacggaagacttgtaggaagtgggactcatgtggagctattggaatctgttccattatataaagagttggctaaagaacaatttttagtataggagtatcgtattatgacaaataagattgaaataagagatgtaacaaaaacttataaagatggagatatattaaagaatgtatcctttacagctgaagagggggaagtcactgcctttttgggaccgaatggtgctggaaaaagttcgacgttacgaatacttttgggtctggataggccatcttcaggcactgctttaataggaggtaagaaatattgtgattttgaacgtcctcttttaactgtaggagcttctttcgatggtgtgggggctcccaatgatcgaacagtttttcaacatttgaaaattgctgctgctagtaatggaatagatttatccagaatatcagaggtattatccattactgatattgaacataaaagatattcaaaaataggaaacctttcattaggagaggggcagaggttaggtattgcaacagcgctgttgggaaaacctcagtacctgattttagatgaacctacaaatggtctagatcctagtggaattagatggtttagaaattttattagagaacaagcaagtgctggtaagacagtattgttatcatcacatatactttcagaagtagaggcggtaactgataaggttgtttttattaataaaggaagcatcatagcttcgggtacacttaataatataatgaacggatttgataatctagaagatgttttctttcatttaacagggggtgactatgatgagtagtataaaaagctataatattttgtcagagctatataaaattttttatagcagatcaacccaaatagttttaccaattgtttttattcttcagccgttattgtcttatatcagttccaaacaaattttaacagttggattgaatgcaacacccgaaactaatagtagtttagcagaaccaatacctccaattgagtatattggttttgatgcaatactattgggcttgtttgctatgataattttaggagcaattcttggaaatatggaatataaaaatagttctttacgtaccagcttgctattatgttcaaataaggttgtattctttgtaataaaatttattgttacatgtgtatttatttttgttgtgtcatttgtctcaatctatttatctattgtaagtgcacagtttggtttaggaagagaggggttgaaccctttgttactgaataagaatgtgtggtattttatattattgggatcactgtcgtggtcgctactaacggtattatcctattcaattgctttttattttaaatcttcacttggagcattattatttttactaccacaagtctataatttaggtagttttcttgctgacagaattcagctagccaagtatttaccagtatctttagggcaagatttaattgcaacgtctcctttgaaaatcacaacaccaggacgcagtgttttatttctgagtatttgggtgctagtaattagtagctttgcatattacaaatttttgaaggaagatgtaggtaatgttagatgaattcttttagaagtgagtatttaaagttcatttataataaatggctattattgactgtactagcaactataattttagtacctttatttgttatttttttacatgaaactccaagttatataaccgagaattatgctttaacacaaatcttagaaagcttctatcttggacaagctgggattattattattacaatactatttatagggcaagaatttaacgattcaactttaagaagcagtttattagctaacccaatacgatggaaattcttttttataaaattaatagttatattatcaatatctgtattagtttggagtctagttaccgtctgtactatttttgtggtatatattttttatagtctattaattcccggatttatttataccattgcagtaagaataatgctggtatcaattggtttaatattaatatgttttagtttagttcttataacaaggagtatagttgttccaatggggatatccttgtctttcttgttggggttaggccaaatgcttctgcaattcagcgatgcctttctctacttcccgattatctctaccatgaattcattttttacgactgaaaatcaaccttatctaccttctacaataggtattgcaattcaatttttatgggggattttgctgttgtctttctctattttgctgtttaggaagagaatagtacgataaaaattttgtattttgtgatattatttaattatgaaagaaaaaaaaatatatcaaatattagcgattgatgacgatgaaagtattcttcgtttgataaagaattctttagaacgctcagagtttgaagttacgacaaggaaagaagtaggtaacatagatatttgttcatttgttggctttgatttaattttactagatattatgatgtctattgatggtttagaaatttgtaaatccattcgagaacaaattgatgtaccgataatttttgtaacagccaagcaattggatagcgatttggctagaggggtaaaggctggtgcggacgattatataaaaaaaccatttagtattacagaattagttgctcgcgttagaatgcatatccaaagggaggagagaaatcgtaaaaataataaagagatatgcacaaagaaaatgataattaatgccagcaagcaagaaatcttgattgaagaagagatcatatcattgacaaagcgagaatttacaattttgtatactttagcaagcaacccgaagagagtatattccgtagaggaactctatgaaagaatatacccgtcggagtcagaggcacaatttcgttctattgctgagtatatttatcaaattcggtcaaaattaaaacccttttcaattaatccaatcaagacacagtggggaggcggatatagttggaacgaaaactagattttaagactttggtcaaaaaaacgcagtggacgattattaaacaattttgtttgagtgtgattgtagcatatattttccccatatcgactatttctattgatattcattcagaaactcagtcaatcgctagtgatttgttaggaatattctttaatgttttttcatgggtttatatttgtatatctttgattattatagtttctgttaatattaaagccttgttgaaacgagtaaagcaagaaatggagattgtctatcatggtagtatgtggctgacctcagtaaacacatcatctaaattaacgattctcgaattcatagaaactaacaaacatattgaactaatgcagcaaagaataaaaaatatgattcaggtagagaaagaccaaaaggaggatattctctttaaggtttcagcgatggcacatgacttaaaaacgcctttgactgtaatcaaaggaaactcggaattgttgcaatttgcacctttatctggtattgatgtccagtgtcttagggacattgaaagagcaagcaaccaattagataactattttaatcagttgattaattactctaaaactttttactctaatcagatttcctttcatcagtatagtatcagtaatttatcaaaaatactggaacaagagtgtgcataccttattggagatagcatagattacaaatatgaaactaagatagggcgagactgtaatattgaattagatttagatttaattatccgttcagtatcaaatattgtcaataatgcaatagcttatgcagatgatgttaaaaagaaaatcagagttatcttggagttagaagatagtagtatttccttaagtatttggaataatggttccaaattttcggacgatgttttagaaaattttggaaaattattttatcgagaagatactagtagaaattcacagtttgaacattttggaataggtttggcatttgtaaaacaagtaatgagcattcattctggtgatatacaactccaaaataagaaaaatggggctatggttaaattaatcattccgataaaaaatagtgactgtacctagtcttggatatcgtaattttgaatactatgaagttcagaaagtaagtatattgataaaaattatttcaaaatctcaacaattagcactcatacctgatttattcacatttgaatatattagatagggtgctattaaaataatattatttttgacgagtgtatgaaattattgttcaaaatgatttttctcttattgtgatttggattatggagatatggcttaattagtaaatatgaaatagtaatgtctatatcaaaaacttatgccaatttggaataaaaactaagattcgttcagaacttgactataattttcttaggagtgaacgaatgtataggcgcattagggatctgagagaggattgtgattattcgcaagagtatcttgcacgatatttatcatgtagtcagtcagcttattctaagattgagtctggcaaacgtcagattcctgttgatttcttgataaaaatctcagaattatatcaagtgagtacggattatttacttggacttacagacacaccctaccgcctaaaaaataaaaaatagtccctcctgatttgttcattgacaattgaataattctgggtgggactttatttatttgttgagcaatagaatataatgcgccaggaaatgagcgaaaatcatttattcaaaaataggatggtaacctatctgccatgacacaaataatgataatgatacttctgaacgttcaggctgccatcgtaaaaggacagcgggtgaaattcctatgattgaactaaccattcaaatcccatctagcgtgtaaaaaaacttagtgatttgaaggaggaaagtgtatgagaactgctacatataaagatttaatgaacttaggatttcctgaacatacctctagagacattattcgtgaagctaaaagaattgctgtaaaaaagtttgaagaagctcgcaaagttgacaataatgcggtacaattaagtaaatcgccctttgacaatcgaagactaggtatcgcaccagcagaaattgtggaacaattaatagggattccactatctaaataacatttagaaagtgagaatccaaatggcaacaaaaagtagtaaaaaatacaaaggtgtttattgtgataataagggaaagatattttatcagattgatcttggaatcgacccagtaactggcaaaagggtacaaaagaaagctagaaaaaatcaatatggtaaaacttttgaaacgatgaaagaagcatatgacgaattagttcgtataaaatatgaatttgccaacaaagtcagtttagaaaattacaatatgacttttgaaaactatatgaacacaatttatttaaaagcatataagcaaaaagttcagtctgtgacatataagacggctcttcctcatcataaactttttattcaatattttggttcaaagccattaaaagcaataactcctagagattgcgaggcttttagattgcatatcatagaaaattattctgaaaactatgcgaaaaatttatggtcaaggtttaaagcttgtatgggttatgcagaaagacttggctatatttcagatatgccttgtaaagcattagataatcctagaggtaagcatccaaaaactccattttggacctatgcggagtttcagacatttatcaaatcatttgacttacatgattatgaagaattacaacgatttactgccatctggttatattatatgacaggtgtacgagtgagtgaaggtttatctttatgttgggaggatattgattttgataaaaaatttctaaaggtacatacaaccttggagaaagatgaaaatggaaattggtatcgtaaagaccaaacaaagactccagcaggtgaacgacttattgaattggatgatataactattgaagtgcttcaagtttggcgaaaaaatcagtttgcaaatcaagatacagattttatcatttcaagatttggagatcctttttgtaaatcaactatttgtcgtatcatcaaacgtaaagcgcagcaagtaggagtgcctgttataacagggaaaggtcttagacatagtcatgcttcttatctaataaatgttttgaaaaaagatattttatatgtagcaagacgaatggggcatgctgataaatcaacaactttgaacacatatagtcattggtttaatgctttagataaaacagtttctgaagaaatcacacaaaatattaaaagtgcagggttggattcaattttatgccaaaattcctgccaaacttcaaattaagaactcaaaccccttgatactgcacatttaacaggttgtgcaattgttactcttaaataatagagtttccaatcaaaataaaaacctatcacttaatgtggtaggttttttcgttctattgttgcaaacgttttcgttgtggggtataatataaaaaatgatgtctaaagattaggagaaagacatgaaaagttacaaaaactatatcttcgatttttatggtacattggttgatattcgtacagatgagaataaactagaggtctggaatcagctaacacagatttacaatgcttttggttgttcctatcgaccgcgccagttgaaaaatgcctatcatcgttttgtagaagaggcagagagctctctcgcggaaacagtgagttatcagtatgtcgaaattgatttagaaacaatcttcattcgtctattaacggatgcaccaaatgaaaaccaaagtaccaataagccgactgatttagagacttttggacaagtagtagccacgattttccgcgtgctttcacgtgaaaagttagaggcttatgaaaataccctaactagtctacagacattaaaggacagagaagtgcgattatttattctctccaatgctcaacgaatttttactcaggcagaaattgaacagacaggttgtgctgatttgatggaaaaaatttatatctcttctgactttaagatgaagaagcctgaaccagcatttcttcaactggttttagaggaaaataatcttgatgttgaggaaacggttatggttggtaatgatttgacatccgatatagctattgctcatgaattgggaatggattccattttgctgaatactttcccgtatagtcaggaagaaatcgactcttataggagacttggttggaattttgaggttgttggagatatagcggagctattgtaaataagcgatagaacagtaaaggatatacataaaatatattatgtaaaaaggtgaaactactttcatttcaatgaaggtagttttgtcctttctagccattttctggtatactagataggtataaaatttagaaaggttctgtttttgggtattcccaaacagtagtcagatattctggctagaggtattagtttcatgtctcaaacccacattaatgttataggagctggcttggctggctcagaagctgcttatcagattgccaaacgtggcattcctgtcaaactctacgagatgcgtggtgtcaagccgactcctcagcacaagacggacaagtttgcggagttggtttgttccaattcattccgtggtgatagtttgaccaacgctgtcggccttcttaaggaagagatgcgtcgtttggattccattatcatgcgtgctggagaggctcaccgtgttcctgctggaggtgccatggccatggatcgtgagaatttctctcaagcggttactgatgagattcacaatcacccgctgattgaggtcatccgtggtgagattaccgaaattcctgaagatgctattacagtcattgcgacggggcctttgacgtctgacgccttggcggagaagattcacgcgcttaatggtggtgacggtttttacttctacgatgcggcagcaccgattgtcgacagctcgaccattaacatggacttggtttatcttaagtctcgttacgacaagggagaggctgcctatctcaatgcccctatgaacaaggagcagttcaacgctttctatgaggccttgatttcagccgaggaagcaccgcttaactcctttgaaaaagaaaaatactttgaaggctgtatgcccattgaagtcatggccaaacgtggtatcaaaaccatgctctatggcccaatgaagccagttggtctggaatatccagaagattacaagggaccacgtgatggcgaatacaagacaccttacgcagttgtccagctccgtcaggataacgcagcaggtagcctttacaatattgttggcttccagactcaccttaagtggggcgagcagaagcggatcttccagatgattccaggactcgaaaatgctgagtttgtccgctacggcgttatgcaccgcaattcctacatggattcgccaaacttattggaacagacctttgcgaccaagaaaaatccaaatttgttctttgcaggtcaaatgacaggagtagaaggctatgtcgagtctgccgcctctggcttagtagccggtatcaatgctgttcgccgtttccatggcgaagagccagtcatcttcccacagaccacagccatcggagctctgccattttacatcacccacaccgaaagcaagcacttccagcctatgaatgtcaactttggtatcatcaaggagctggacggaccgcgtatccgcgataagaaggagcgttatgaggcaatagcagagcgttccctcaaggacttggaagagtttttgacggtttaagccgatagttttccgacgaaaagtatcgggaaaacttggatggtagatggtaaactgatagggaaaggggaagttgatgataaaagagttcaatgcaaccgtacgttacctagagtccgttttagaaagcgaaatcgatgaacgggaatttttgcgcatatcaggatattccgttcccatgtttagtcgtctcttttcgattctgacagatatgtccttgtcagaatacgttcggttacgaaagttgacgcgagctgctatggacattcgtgaaggacaggcaaagattatagatatagcccttaaatatgggtatgaatcttcggattcttttgcctttgccttcaaacaatttcatcagatttctcctagtcaagtgcgtaaggggttgccttttaaggtcctcttacccttgcaactatcattaaccatccaaggaggtaaagaaatggatgttcgtattgaaaagaaggctggttttacagttgctggacttcttcgcacagcaatcagtaacgaagtgtgtccgcaggtatgggaagacttgttcaagaaccatacttatgaagagttagctgctctaggaagtgggcagtcctttggagtttgtacattagctcaagcggacgagacgattaattatatggctgcttatgatgtcacagatagtgaaaaagcgactaagttaggcttagaacttcttgatgttcacgaagctgactatgctatttttaccctaacaggccctgttcctcaatctattcatgcaggatggcgttatgcgctagaaactttttttcctgaacacggctatcgccattcaggtgcaccagattttgagtactattttgaaggagacatgagttccccagactaccaaatggaactctggattcccattgtgaaagcataatgtacaggacaccttcgggtgtcttttgtgttatactgggattagaaagcggaggagaaatacgatgcaccacaatacttggaagggaattattctgcagaaacaaggtctgttgaacccccagtctgttcaacaaatctgccaaaatctcaatggtttgcaggctcagtttcagccctatgttcatgtcggatttcgtaaccgtatgacagcggaggattttcatgagggtagctggcaggaggaactgactcgtcagtggtccattcggcgaacggttcatgcctatctcgagtcggaaattcctctctatatccatgaggggcggctggtcagcaccgattacctcaagacagaaggacgggacggttttagtcctcagaccaagcagaaatatcaccatctgattttagaagcccttgaacaaggtcctatgacccgtgaggatctcaaggtcctttgccgagaggaaaagatgacacagaaagaggagaagctggtctttaatgcctggggcggtctctttcgctacatggtcgagcgtggggaagtctaccaagagtacggtgccaagcgttttcatcgtctgacagactttcagccactttctcgggaaaaagctgagctggaaatagcacgtcggtatttttcaggctttgggccagtcagtctagcagatgctcgttattatttcaaagaaaataagtcaaccattctagagtggatggctcaattagatttaaaaacaattcaagtagctggagaggagcggttttaccttggggtgcttgatgaggcagatttacctcagtgtcttttcgttgctgggtttgatcaattacttttgggctatgaaaagaaaaacaacccatttttcgatccaaaatacatccgtaacatttatacgttgacgggtattgtcaaacctgttgtattttataaagggcgatttgtggcaacctggaaacgtgataaaggtaccattttgctagatatttttgaaagcatcacccaaaaagaagaaaaagaattagattattaccgccaaatgtatgagaaaattctgtgacattgactaactatgttcggaaaatccgaaaattgcaaataaataactaaattttctgaatattccagaaaaactatgatataatacttaaaatacgtaaggaagagatagatatgaataagtcttacttttatttggacatgagaactcatgaattagatgtaccatttacagaaagaaaacgtcgagtccgtgttttattgccgaaaggatatgctgaaaatacagaagagacctatcccgttgtttatttccacgatgggcaaaatgtactctacagtaaggaagctttttcaggtcattcatggaaagtcatcccaactattaagcgtaatccagacattgcaaaaatgatcgtagtggctattgataacgatggtgctgatcgcatgcatgaatacgctgcttggaagtttagtgagatggggattcctggggtgcagttcggtggtaagggaaccttgtatgctgaatttgtgatggatgtcgtcaaaccatttattgatcaagaataccggacaaaatctgataaagttcacactgcaatgattggctcatccttgggaggcaatatcacccagtttatgggattggcttatcagaaccagattggctgtctaggagtattttcatctgccaactggcttcatcaagatgctttcgaccgttatattgaacgtcaacaattagactcagagcaacgagtctacatctacgttgggacagaagaagcagatgatacagataaaacattgatggcaggaaatatcaagcaggcctatatcaattcttcattgacttactatcgtcaattgatcgctggcggagtggatttggacaatatcgccttggaagtcgtttcaggtgcggtccataatgaagaggcttgggcgctctatttgccagcttgcctacgattcctaagcgaacattggtcataaaacaaaaatatacaaataggaggctttactatgcacgttgaatttttaagtcattggtctggaaatcttggccgagaaatgaatctaaatcgttatggtcacgtagggattcctgttgtcgtatttgcttcatcaggtggttcttacaatgaatatgctgattttggtatgattgaagcttgtcgtggctctattgaagctggtcaggtccaattttttactctaactagctacgatagtgaaagctggttggcagactggaaatccatccatgacaaggcagaggctcaccgtgcctatgagcgttatgtgattgaagaagcgattccctttatcaaacataaaactggttggtttgatgggatgatgacaactggttgttctatgggagcttatcacgcgctcaatttcttcctgcaacatccagatgttttcacgaaagttatcgccctttcaggtgtctatgatgctcgtttcttcaacaacaatcaagattatggcaatgatgatgttgtttatcagaactcaccatcagattacatttggaaccaaaacgacggctggtttattgataaataccgtcaggctgatattatcgtctgtacaggtttgggcgattgggagcaagacggtttggactcattctataacctcaaacgtgcatttgaagagaagagtatcccagcttggtttgatacttggggaacagatgtggcccacgactgggtgtggtggagaaagcaaatgccattcttccttcattctatcggactataagctagaaaggactacctatgaattatctcgttatttcacctttttatccagaaaatttccaaccatttaccattgaattggcaaaaaaagaaggcgttacggttctaggtatcgggcaagaaccttacgatcaattgcctgaagaacttcgtaatgccttaacagaatacttccgtgttgagaatcttgaaaacttggatgaagtcaagcgtgcagcagcctttcttatttacaagcatggtccaattgaccgtgtagaatcccacaatgaatattggcttgaaaacgatgcagccctccgtgaacaattcaacatttttggtgctaagcctaaacacctgaaaaagaccaaatttaagtctgaaatgaaaaaatatttcaaaaaagcaggtgttccagttgttccaggtgtggttgttaaatcggaacgtgattttggcagagctttgaagaatgttggttttccaatgattgctaaaccagacaacggtgttggagcatcaggtgccttcaaaatcgaaaataaagaagattttgatcggtttgtggagacatgggatggagcaactatttatttcctcgaaaaatttgtcaattcaagtattatcactacttatgatggtttgttggactacgaaggcaatgttgtctttgaaacaggcttgacttatgttcatactacatttgaattgatgcaaaccaagaaggacaatgcctactttatcgaaaaagaattagattttaaactggttgagtatggcagagctattatcaaggcctttggtatgagagagcgttttttccatattgaatttttcaaggatggggacgactacattgccattgaatacaataaccgtatggcaggcggtttcacagttgaagcctataactacgctcattccattgatcttttccgtgattatgccaatgtcgcaacaggtggtacagttgaggaacgtagatttgaaccacaatactgcttggtagcaacccgccgtgatacgaccgaatatgttcactcagcagatgatatccatcagacattcgctggtaagattaagacagtcaaacggatgccagatgcctttgcggaacttcagggaaatgatgcctatcttcttgtaacggaaagcaagaaagagttagatgaaatgattgcttatattggtctaacaaaataaaactaactgtaagacgccagaaatggtgtcttttattctttccttacaaagctgtaagttttttaatcagaactgtaagagagtacaggaggaatattttctataatagactcataagaaatagaaagaaggaaatcatatgtcattcaaatttctacaagcaaagagaatagaagaaaaggtattctctgaaaaagagaaagctgaactcatggaacaagccttattcttagaagagctcgcccataatttgcaaagtatgcgatttatggcatactagagggaggaaactatgaaaaagaaagtaattagcatgctggctttgggaagcataatcctaactgcttgctcttcctcttcagcaggttttagctttgatgagggctatcaaactttccattacaagggaaaagtctatgccgttagcaaacaggaagttgccgaagatagtattcaaggaacagaagttcagtttatggaatggcctgttgtcaaagaagaaggggcagtgaaaaagacagtatccttgaataatctctatgtaaccactaacaaggaatgggccatcggtgtccaggatggttactataaggtagatttagaagaaaatgttgctgaatcagaccgaatcgactatcaaagtgtacttgagaatgttgattttacttaagaaatcaattaggagtttatatgttattagaaatcaatcatttaaaaaaagtttacaaagacgttaccactgttgatattgaaaagattactgtacgagaaggagaaatctacggctttcttggaccaaatggtgcaggtaagacaactacgatgaaaatgattctatcacttgtcactccgacttcaggtgaaatttttattaataaaaaagacattcgaaatgacaaaaaatacctaaatcagattggatctatgatagaagaaccgtcctattatcctaatttaactggatatgaaaatttattagtgtttcaaaaaatggtgggatttgataaaaataatatccggccaacattggagctcgttggattagctgatgaaaaaaatcgaaaaaaattagttaaggcctattctcttggtatgaaacagcgacttgccttagcatttgctttagtgaaaaagccgaaaatcttattattagatgagcccacaaatggtcttgatccagctggtattcatgaaattcgtgaattaattgttcaattagccaaagaaaaaggtctgactgtctttatttccagtcacattcttccggaaattgaacacattgcagatcgagttgggattatcaatcatggtcgtcttgtctatgagggagaaattgaagctattaagtcaaatacttggattgaaattggcggtgatttttcacagaaaaatattgttcagaccttagttgaacttggaacggtagaaattttgagtgcatccgaaagtcaagtaactttaagggatttggataacgatcggttagcagatctggtgagctatttaatagaaaatggataccgaatattccgagtggttagagaaagtgaaactcttgaagatattttcctaaatctaacaaaggaggcgtaagatgaatggtgtttacattgaatggctaaaaagtagacgaacaaaatctatttcaattgtcattattttgatgttggttgccacactttggaatattgcaacttttatctctgctttctcttcacatccagagttaagaatggctggaaccttgtttagtaatcagaatgtcaatctacttatgttcccgattgcagtttgtgtgtttgctagtcgaattgtagggaatgaacatgaagggcagacctttaaactacaaatagctaatggtcaaagcctaacagccatttttcgtgataaattcttttttatgctggtttcctttgttattatgtctgctatcgaaattatgattatttatcttttcggaacacaggcaggaatctctatttctttgcagattattggtattcagtttattgggcagatacttgcaatattttcattgatttgtctttatctgaccttggccatgattcttgaaaagcaggggattctgctagcactaggacttttaggtggttttctaggaattatcttaaacccaaaaagttatggttttaccagtttacttaacccaatcactggttcaggaagtcttgcgccttataaatatcaatttctgggtgacggcacaattacctataatttagatagtcagttgcttgagaaaatcgtctgttatgccatttactgcttgatactctaccttttggcggttctaatattaagaaagaaagggaactaagatgaaagattacttcttagctgagtggacaaaaacaaggaaaattcaattattagtcattgggattgcctttttgagtttctctagtatgataggattgggtatctattttgctaatcgtgatgttttaatcgacggaactcaatctttggttctgtggggacaactgaccttttacaatagtaccttactttatcctcctatgttagccattattgcaggtctcttattagttcctgaatttgagcgaaaaactcttgacatgctaaaggctaatcaagtttctatgaggaaattatatttaggaaaattaatgagcagttttcttcttattcttccaattcaactcttattgctgctgatttttatagttgcggcaaaaattgacggcatttcatttgaccttagtttagccacacatgttaaatggattgctttatcgcttttgtcttcctttccaattattacactccaatcctatatcactgtaaaaactcgaaatttcagtaagggagtcggtgttgctaccattggtagtatgcttaattttgtattaatttttatcaatgaaagttttacgaaatttttcccttactctcaaccgatgattggattacggagtagggcattgcaagatatgacatttttagagtttatcttatttattacagtgaatattgtgtttagttttattttttatcagttaactatcaagaatttggaaaatagtaaataaaaaccttttacaatttcatgtatttcttttataaagctgataattagaaactcaatttcatgggatttagtaccaaagaaaattagctatactaaatcaagttaattttgctaaagaaaacaattaggagtaactatgttattagaaatcaatcatttagaaaaagtttaccgcacgcgcttttcaaaagaggaaactcgtgccttgcaagatgtggattttaaggtagaagagggcgagtttatcgctatcatgggggaaagtggttctggtaagacgactttgctcaacattctagcaaccctggacaagccgacgaggggctctgttatcttaaacaatcaagacatcaccaaaatcaaggaaagcaagctggcagatttccgtttgcgtaatcttggctttgtcttccaagattttaacctcttggacaccctgtccatccaagacaatatctttttacctctggtattggcacgtgagagctatcaggaaatggagaaacggttggaagtattggcaccaaaactacggattcaagatttgctgaaaaaacgtccctttgaactttctggtggacaaaagcagcgcgtggctattgctcgtagtttgattacccagccacagattgtcctagcggacgaaccgacggctgccctagattatcgcaattcggaagacttgctgaatttgtttgaagagattaaccgtgacgggcaaactattctcatggtgacccactcggccaacgcagccagccacgccaaacgtgtcttgtttatcaaagatggtcgtattttccatcaactgtacaaggcagacaagagcaatcaagactttgccaaggagatttcactcaatatgtctgcacttttagggggtgagtagatgttttacctcaaacttgctgggcaaaatatccgaaaatccatgggtgtttttgctcccttcgttttagccagtctggtcctctttaccctgatttgttccatgttcttgatcatgctgagtccagttatgaagaccatgggctctggtgccatttctatcggtcttggtgtgattattctgaccattttctcggtcattatggagatttatagttttaatttcctgatgaaacaacgggcgagagaatttggtctctataacatgctggggatgaacaagaaaaaagtagccttgatagctagcctcgaattgatgatgattttcttgctagttgtggttcttggttctgttttagctggtgtgtttgcaaatgttctctacttgatttttgtcaatataacacattatagtgatttacattttggaattgagcctctggcctttgtcatgactgcctttctctttgctggtttcttctttctcttggaattgctagccattcggaccattggcaagaccagtccgctgattttgttccgagctagtgaaaaaggagagagagagccgaaaggaaatgttcttctagctgctcttggtgtttttagtcttgggatgggctactacctatcgctttcatcgaaagcagaaggtctagctgttatctatcggttctttatcgctgtgctctttgtcattgcggggacctatctgttctacatcagttttatgacttggtatttgaaggctcgtcggaaaaacaagcggtatttctatacgccagagcatttcattacgacatcgcagatgatttttcggatgaagcagcacgcaacgggtttggccaatattacgctacttgcggtcatggcctttgtgaccattgcgaccacaacctccctttatacaggtatgagcagtatgacaggtgcactatatcccaaggaaacatctattacctataaagtttcggatagaagtcaaggtgaaatggccttccagcaatcggtgctcagccattttccagaaaaagccgatgacagtctatcctatctgacctaccaagctggtctggtatatgatggtggcgaagagattgtcattagcccaaaaaatatttctaatccagatttttctaaaatggcctttacctacttcatcacccaagatgatttcagaaaattggggaatgacctgccagagcttgctgccaatcaagtggtctttatgcgtccgagcgaaaaaccatcgctgaagaagcttgttttgggcgatcaatcctttgagaatgtagccaatcttgataaggctattttcccagacatcaccaatacgctaaatgccgccgttatggtagtcagtgatgacacagtgttgaatgctgttcgtgagtattacgaatccaataatccgcaaggctatcttgttagcctagattatcgtgtctttaccgacttgactgatgaagaggtactctctcttggagagcaatctggtgaaatatacgaaattctcgatgaaaatggagaatatcttggaaatgttatgcaacgtacggatttcaacaatttactgatgggctttacaggcggtttcctctttacaggtttcttgctgggaattagtttcctactgggtgcagccttgattatctactataagcagtattcagaagggcatgaggacaagaaatcctacaagattctacaagaagtaggcatgagccagaaggctgtcaagaaaacaattaactcccaaacacttacggtcttctttatgcctttggtcatggcgaccctacactttgtcatcgcccttatcatgctcaagcaaatgctactaagttttggtgttacctcatcactaatgatttacacagtcagtggcatcaccctactggcagtcactctgatttactttgtcatttacaagtggactagtcgcacttattatcgcattattgaacggtagcagaagtctcgccttgtgcgagatttcttgctttttcagggaaatggtgttacaatggtaataccaaaggaatactcgaagaggtgagaaaatggcagctattacattgaaagtttctgagcaggacaagctctttatgcaggctatggcaaagtttgaaggtgtcagtttgtcagaactcattcggactaaaacccttgaagctctcgaagatgaatatgatgcccgtgtggcagatatcgctctgtctgaatacgaggcagacttggcgaaaggcattgagccgattagctgggaggaaatgttggaagagttggggttgacggatgaagacctgttataaactcgtaccgaccagtcgttttattaaacagttgaaaaagttggacaaatttacccaaaaacagattaccaactacttgtccagtcatgtgactgacaaccctagacaatacggaaaagccttgactgctaatcgttctggccaatggcgctatcgtatcggcaattacagggttatcgttaatattgaagatgataaattgattgtgacaagcataaaaatgagaaatggaagtatataagccaagacctgtgtcctggcttttgcagaatgaagaagatgaaaaaagagaagatttatattgttgaagatgatgagatgattgtccaactcttgaagcagcatttgggaaaatcttatcaggtagaaagtgtgcagaatttccgagctgtcagtcaggaagttgcggaaatcaaaccagacttagtgctgatggacattaacttgccctattacaacggtttttattggacgacagaaatccgtaaaaccatgaccatgcccattatctttatctcttctagcgatgatgagatgaatgcggtcatggccatgaacatgggtggcgatgattttgtctccaagccattttctctaggaattttggatgccaaaatcggagccttcctgcgtcgggttaatcaattcagcaaatcgagcgaattgtctatcgatcagttccagcttagtttggacgggcgattttcaaacgaatcggaacaggttcagctttcacctactgaaaccaagattttatccgccttactagaaagacaagggcagattgtcagcaaggatgaactcttggaaaaactctgggaaaatgaagaatttatcgaccagaatacgctcaatgtaaacatgaccagactgcgtaagaaggtgagcgaagtcgggtttgaacgaattcataccgttcgtggcgtggggtacttgatcaaatgatagcaaaatttatccgcgaataccggagtttttacttctcctacattgttctggctactagttttatcttgctcttctttctctatcaactgcccaccgaattcctgcaaaacgctctgctattgtccctaaccttcttaatccttctaactgtagggcttttctggaagtttcgcaaccgcatgagagccttggaagactatgtccatgaagaagctctgcccctgcttaataagcctgtggacttggcctatctcaacttgattgaggcagagaaggaggcgacacgggagcagcttttggtctataagtcacgagaagaagacctgcaagctatggtcaaaatgtggtcccaccaaatgaaagtgcctttggctgccctgtctttgatgagccagactgacaatctcaaccagcaggatgtcaatcaccagctcttacgcttggataattacatggccaatctcctcaactacctcaagctgaccaaccatgtcagtgattttcgttttgagcaggtggaagtaagagaagtggtggtggatttggtcaaaaaataccgcaatcagttcttgcaaaaggacatttcagtgattatcgatggaaattggctactgaaaaccgacagaaagtggcttagttttgccctatcacagattatcgacaacgccctcaagtacaataagactggtggaaaggtggccattgaattgaatggaggaatttccattttcgatacgggaattgggattctggcagaagaccttcctcgcctgtttgacgagggatttacaggttttaatggacgagaacaccaaaaagcgacaggatttggattgtatctgaccaagcgggtcttgaatcagttggaactagctatttccgtggaaagtcaactggaaattgggacaactgtaagcattacaaaagtacagtagaagctgtgcttttttcattttgaaaccgcttcgaaaatatgatatactaaatttagtttgaattaggaggttactatgtcccatcatcacgtcttgcaaaatggatcagatattcgtggaattgctatcgctacagacgaatatgctgtcaatctcactccacaagccacccaggaagtagttcgcggacttattcattggctaactcagaagccggaactggcgcaggtctatcaaaaaggccaattgaccatcggtatcggtcgagacagccgcctcagcggtccagatttggtcgcagcctttacagaagaagccgtttgtctgggcgttcagctgattgactttggcatggccaccacgccagctctcttcatgagcacccagtatccgcagttcaagtgccacgctggtgtcatgatcactgccagccacctgccctattacttcaacggcattaagattttttcggaaaatggcggagcagaacatgaagatattgacttcatcctctcgcatagtgaagacttgccagcttcttcccttggaagtatcaccagtgcagacctgattacgccttatgcccaagatctggttggtaaaattcgtaccgcctgtggtggacaagaaaaaccactgacaggtcttaatatcatcgtcgatgctggaaatggtgcgggaggattctttgctgagaaagtgttggcagaattgggagcagataccactggttcacaattcctagacccagacggcaccttcccaaaccatgttccaaacccagataacaaggaagctatggaaagcattcgtcaggctgtcttgaagcaaggtgcagacctaggcattatctttgataccgacgttgaccgtgccgccctggtcaccaagtcaggagaaattctcaatcgtaacaacctgattgccgttctcagccagattgtcctagctgaacatccaggaaccagcattgtgaccaattccccaacgactgaacaccttaaggtctttatagaaagtctgggaggcaaacaaattcgctatatttcaggctaccgtaatgtcataaaccgtgctattttagccaatcaagaaggagttgattgccagttggctatcgaaacatctggacatgctgcctttaaggaaaattacttcctcgatgacggaacgtatgtagcggctaagattctcatgctcttacccaaactgcaagcggaaggcaagtccttggacgacttgattgcccagctcaagcaacccttggaaacccaagaagtgcggttcaaactggaagccacagactatcgagcgcttggtgaacaggtcattgctgacctccgccaaaccagcctcgaaggctttgcttttaacccagaaaacgaagaaggagtgcggtttgacctgactgagccttatggtgacggctggctcttgctccgtatgagcctccacgagccgctcttggtcttgcaggtggagaatgaccagactggacacatacctgccgttttacgaactctctcagcctttttggaccagtacccagcagtcaatcaggaaaaattgaaagcattgatttagatttaagagaaaaaggggtaagttttcgcttactccttaatttatttacataatttatattacgtgatatcacaactgatccagagcatttttctgttcatcgttgacgatatgggtgtagagatcggtgacctgggtattggcatggcccagctgatgactgactagaacttgcgacttggtggcgtcgtagagacgagttgccaatgtgtgacggagtttgtggggggttacgcgtatcttgaagtccgcagagtacttggcaaccattttttcaatagaagaagcatcgatacggttaggcagaccacggtattcggacaggaagaaggctgtatccgttttttcagccttgtagcgttgctgacggatgcccatgtaggcttctaagtagggcttagcaaacccagccacattgaccgagtcccgtttaccacccttacgagttacttcgataatcatcatattgaggtttacatctcgaagatccaaattcaccgcttctgacagacggacgccagaagccaagagaagcgccagaatcgccaaatcccgctccttatttttctggaaggaggagagggcacgtttagagagattgacttggtattccttgtccacatagtccaagaactccatcgtttcatcgcccaaaaagagcttttgcttgatgttctccgcccgcgctgccaaggtttccttcttcttcttagtagatacctttttcatgacattgcggtagaagtagggctcgccctgctcattctccacttcttcggttaaatacttgaagagactagaaagggccgagagggtacggttaatggtggtctgcgacacaccattctgcgtggtattggcgttcagcaagggacgctcccgcagataaagaatgaaagcttccatatctttttttgtcagatgttccagaacatccagcggaatgtcagcaatccgttcaacagccaccaaatccgaatcctgtaaccattcaaaaaaacgacggtattctttcaagtattcatataaggtagtaaaactgtaaggcacagccaattttgactgataatattccagaacaaaccaaggcataatttcttttagttgatcaattttttccaataataactcgcgtctcatcattttctcctgatttttagttatatgagtagtatagcataaccttatataagtttcaagaaaattatagtttttcggaaaaatgtttgtggggatattagaaagataaccaaaaaaattttttaggaaaaatcagctaaaaatgtactttaataacgacaaaactggaaattttttccaaagtacatttttctagttaatttgatacctaaaactatgttttcggacatagagatacccccattttttacataaatttaaaacagatctatactttagacctgttttattatttcttaatatgagtgactttttaatgcatctacttaatatttagcaaacaaagattattctaatttcaaattctagtatacaaagaattatgttgcagacaattcaatacttccttgtttttaaggccgtagtaatttgcttgcctttggcttttgtcaatcaactttctaaatgaaccaaaaatttctctaaaattatattggttatcaatagcatccatcatatatttcactataataatcggcagagcaatgcggtttgaataaacaccttcttttagttcgtataagagctccttccattcttcacgaagtattggtgttgtatgcattttaagatcaataatattcgaattatgagcacacatattacgtaataaattcaaacatttcaaccaagaaagtaactcagcatcactgcaatcatattgtttagctatttgtctaatattatttgttgacatcaattcgataaggttgattatctgaccgaacgtcattaggttaatagccaaccaaattggaggatatttcatattgtcaattttcaatttttccttgatttctggagaagttgttcttttcaattcagctttgagctgctttttaaatttctcttctcgatattttaggtaatgcttgcagtactcttttttattgcaccactgtgagaaatttaaatatccatatggccctaatctcctataacctaaaacaaatgctacttgggttttaaagctacctcaatgtcttcgagagcatccaatagatggagacgcaatcgtttatcttgataatatctaacagtaatttttttgaatggggtgttttggtaatttatttgacgcactccatcaactgtcacaatttttgaaaaaggtctagcaaattcctttaatttatagtaagaaattattgataacttttgctcagcttttttcttgtcctgctctccagaaaacagcatgcctcttgcattctaacaaagcaacttgttcctcaaaacttttatgggaaaaactactcatttgaacactccttaaacaaaaaaaccacccatcagaacatgtctgtgcaattgaagcaagggcggccattgatatttcaagttcattatatagtatatttgaatatacgtcaagttttttatcaagaaaatctgagaaattagctgattttattatttttgctctacgactaacatctaaaaatgtacaattgctccaatctcctcccctctattttctactacattttgtacaattggatttctaacactaatacaataatatgctttaatcctgtaccttattgaatcctaaaataatgtacaaaataaaaataaagtacattttttgaagaatgtactttatgcttctatctcagtattatcaagggttcaggctatattaggtcaattgttcataattttttagttttcgagataactagaaaatttttttcacgtccaaaatcctaaaaatctagattatttctcggtaaactcacatagcattagaatcttcttcgcaacctcttctggcttcaaactgtctgttttaaacctttgtcctggaatctgactttcaaaagattttaatactcttcgaaaatcaaaatcagacgttgttgacttgttttgatgaacttcagttctatctgcatctacgtcgcctagtcagattttgattttcattgagtataaacaatcatcaagatgtcttttggcccagatgttgtcttcattgactcgattatctaaacgttccaaaatggttgttttgtcagctaacaaaatataatgttccaaaggaatcttatcctgtatcaattgctgaataatctcctgataatattctttcttatagattgtcataggaataataataatcttatcggttttagtcgctaaatcaaatactattttataagtactctgtcgccaaacggaataatcttgaaaatcttcaggacatacagtctgaggtaattgatgttgtaagaaatcacctagtaattcgggattatagagatatgagttttctattcgtttgtgtaatatatttgctaaagtagtctttccgacaccgaatgggccatttaaccaaataatcatatagtatttctttctatttttataataaaagtttacacaaaataaattatgtaaactatttgttttataaaatcaataaaacgtacaatactaggacactgatgatactaaatagcgaaccaattaaatagtattcagcaaaggcttggcttttggatattttatcatagcgtgcgatggactttgctgtaaataccagtccgatagctgtgtattgccccagaagcagaaaaattcccattatgaggcgctccaattgaccaatcaaggctcctgcacctgtcacagtctgctcttcttctccttccgctacctgatatttgctaaagtagagtttgaaaagaatattgacgggcttgctgatcagaaggataaaaaggatttgcaggaggagataatttggttcaatccagagtgagtgtgaagcgacattaacaccgatagtgtgataaagaatgatgattgagatgatatggagcaattgatcaactaggaatgctccagcttcccaggagtcctttatccaatggtgtttgttgagaaaatatttgacatagtcaatcgcaagatggctcagccaaacttgaaaaaataaatctccgttttgaataggggtaagtaaggctaggataagaagagggatagcaacaatgaaaaggtgcatgaaaagagctttcaaatgaagctttttagcatccgccagtgcttgactctggaaggtaaaatcacttaaaaagtgggcaataagcaaggcggttaaaactggatgttgaataagatagctagaaataactgaaaatgacatgctttatccttctttctgactgagctggagaatcaaattcatggcagtttgacgattacgcaggtagagtttgattccgctggatttcaaacgtttggtaaaggcgctttgactgagtttcattttctcagcaattggcttttgtgtgaaatcttcttgatagatttttttggagattaaggtctcaaacagatccgtttgcgaacgattccaggcagctttgatgaaatcgctagaagttagcaaggggttaatcacacgatcgatttgcttgtattcagatgaaaatgcaattttgctggtgccatagtcatggttgtcatgaatgaagtcaatagccttgcgtgcttcccaataagctggaccatctgctccaatacttagcttgggatcgatagctgttagaatctcacccaaaccaattccaaatcgaatctccacctcatcacgaaaggctagttggatttggtcaattataaaaaaaatataagggttaggcttgcataaggcttgaaattcatctccctttgtaatggtaaatggcgatgcgaagtcctgagcgaaggaatgattgattctatttagctgctgttttagccgctcttgaatactagagcggtttgaagtctgttttgaattgacaatatctcctattattgcgatataattcataacttatcctctaatttctattatatttccattataacggacaatataaagattgtccactaaaaaggacatttttgaatatttctgttataacggaaagtgttggagtttgaaaatcatttttcctgctttgctacttctattttatattgctatatcttacttcttcgaataaaaagtaaaaaagaagagattattttctcttctttttggctttcttgattttattggcttggcgtttcatggcttgtttcatagcaaactcaccaattttacctttcaaaccgcctccaaacatttgggacatatctggcagaccagctcctcccatcatatcttccagagcagacatatccataccgttcatgtttggcatgtttttagggagattatttgggttgattcccatttgtttcatcattttgttcatgtcgcctgacatgacaccctgcatcatggttttcgcttggttgaaatccttgataaatttattgacttcgacaaagctatttccagaaccgttagcaatacgacgacgacggcttggtgtcaacaaatcaggattttctcgttcggctggtgtcatagaagatacgatagctcgttttcgtgcaatttcacgctcgtcaactttcaagttggcaagtgctgggttaccagccatacctggaatcatcttcagcaggtcttccattggtcccatattttgaacttggtccagctgatcaatgaaatcgttgaaatcaaaggtattctcacgcattttttcagcgagttctagtgatttcttctcatcatattctttgctggctttttcaatcaaggtcagcatgtcgcccatgcccaaaatacgcgaggacatacggtctgggtggaaggtttcaatatctgtgattttttcaccagtaccggtgaatttgattggctgaccagtaatgtgacggacagacaaggctgcaccaccacgtgtatcgccgtcaatcttggtcaaaatcacaccagtaatagccagttgatcattgaactcacgcgcaacgttggcagcttcctgaccaatcatagcatcgacgaccaagaggatttcgtttggctgagcaaactctttgatttctcttagttcagtcatgagggcttggtcaatctgcaaacgacctgctgtatcgatcagaacgtagtcattatgattagccttggcttgctccaaaccttggcgtacaatctccagggcagggacttgattgcctaactcgaatacaggtacatcaatttgttgaccaagggtcttcaactggtcaatggcagctggacgataaatatcggcagcaatcaagagtggacgggcattttcttcctgcttgagtttattagccaacttacctgtgaaggtcgttttaccagcaccctgcaatccagccatcataatgatagttggaatttttggtgatttgataatttctgaagtttcagaacctaatacagccgtcaattcttcatcaacgattttgataatttgttgagcggggttcagggtttcaatgacttcatgaccgatagcacgttcacgcaccttcttgataaagtcttttacaactggcaaggcaacgtcggcttctagtaaggccagacgaatttccttagttgcttcctgaatatcactctcagaaatttttcccttacgacgcagatttttaaaaacattctgtaaacgttctgttaagctttcaaaagccatatacttctcctcttattctctattatcaatactggttagaatagcgattttttccttcaaataagcatcttctggatacttgttcagtatttcatcgaaaatctggctacgcactacatagtcagaatacatatgtagtttcatctcgtagtcttccagtaatttttctgttcgtttaatgttatcgtagaccgcctgacggctgacttgaaattcttcagcaatctcagccaaactgtaatcatcggcataatagagctcgatgtagttcatttgcttgtctgttagcaaggctgcatagaattcaaataaggcattcattcggttggttttttcaatttccataaacttcattatatcaaaaattccatattttataaataagaaaatccgtcatcactagaaagattacggattttaaaaatgttttacataattatttttatgttaattgttttctaaatagaattcgaaacgttccccaacatactgactatttacaaattcaaatgcttgaccatcctcgagataagatacctgttttagtgcgagaatagcctggtttttagaaatttgtaaatattgagccactttttcattggctaaacgcgcaaaaatagtttgtttgctcgttccaattcgataaccattgtccataagtgttttaaagaaatggttggtaacatcttcttttgggacattttttatcaagcgttcaggaatgctggcaacctcatacacgacgggaacattatctgcatagcggacccgctccattcgaataacatactcgccacgggataaacctaattgttcaacttctttttcattaggtttggttcgtgtataggacaataatttgctgcttggcgtctttccttggagttgtactaattcagtaaaggaagtcgtgcctcgcatcttttcttgaacccgtgtactggcgacataagtaccggaaccaatcttgcgttgtagaataccttcttccactaaaagtgtgattccttgacggagcgtcatacgagaaacaccaaattcatctgctaaatcgcgttcacttggtaaacgttgaccaattttccagattccgttatcgatttgttccttaattttatcgtgaattgtgatatatgctgctttcatttatctagcctttctcttctttctagtttaccaaaaataaaggcgtttggctaattcaggccacactctattggtaaaattctcctaggcaaacaatgaagtcagattacctaaaataaagtgagtaaaaacaataaaaatacgaacactaacatttttattatcactcatagtttgcaaaacagatatttaacaaataaaatttggaaaatgttcgcttttatgttaaactaactactagtatttgaatttttttcaaaacgaaagggaaaaacatgacaaaacaagatgtccaaaaaattattgtattggattatggtagtcagtacaaccaacttatttcacgtcgaattcgtgaatttggtgtcttttcagaattgaaaaaccataaaattacagctgaggaagtccgtgctatcaatccaattggtatcgttctttcaggtggaccaaactctgtctacgcagaaaatgcctttgatattgatccagaaatctttgaattgggtattcctatcttagggatttgctatggtatgcagttaattacccataaattgggaggtaaggttgttcctgctggtgaggctggaaatcgtgaatatggtcaatcaaatcttcaactgaagactgaatcagcgctttttgctggaacaccagaagaacagcttgtactcatgagccacggggatgctgtaactgaaattcctgctgatttccacctggttggtctttctgctgactgcccttacgcagccattgaaaacacggaacgccgtatctacggtatccagttccacccagaagttcgtcattccgtatatggaaacgatattttgaaaaactttgcgtttggtatctgtggagccaaaggcgactggacaatggaaaacttcatcgaaacagaaattgaaaaaatccgccagactgttggggacaagaaagtcttgctcggtttgtcaggcggtgtagattcgtctgttgttggggtccttcttcaacgtgctattggtgaccaattgacctgtatcttcgttgaccacggtcttcttcgtaagaatgaaggtgatcaggttatggagatgttgggcggtaaatttggcctcaatattattcgcgtcgatgctgctaagcgtttcttagacctacttgctggcgtatctgaccctgagaagaaacgtaaaatcatcggtaatgaatttgtttacgtatttgacgatgaagcgagcaagttgactgatgttgaattcctagcgcaaggaacactttataccgatattatcgagtcaggaacggatactgctgagacaatcaaatctcaccacaacgttggtggtctgccagaagatatgcagttcaagttgattgaaccgctcaatactctctttaaggatgaagttcgtgccctcggtactgctcttggtatgccggatgaagttgtatggcgccaaccattcccaggaccaggccttgccattcgtgtcatgggtgaaatcactgaggaaaaacttcaaactgttcgcgaatctgacgctatcttgcgtgaggaaattgcaaaagcaggtcttgaccgcgatgtgtggcaatatttcacggttaatactggcgttcgctccgtaggtgtcatgggagatggtcgtacctacgactacactatcgctatccgtgctatcacttctgtcgatggaatgacagctgactttgccaaactaccatgggatgttcttcaaaaaatctctgtccgtatcgtaaacgaagtcgaccacgtcaaccgcatcgtctatgatataacaagtaaaccaccagcaacagttgagtgggagtaaattagtccagtggactaatttacccgatgcctaaaaacaaaaaagtgtcgctgatctgggaaatcaattaaccagacgctccaaaataggaaagagtcttataaaaaaacaatcaaagagtagtttagtgctactactttgattgtttttttgttttctagcttagagctctaactagtacagttttggaggggatgcaaaatgcgatgtaatgatgtcatccagttgttcagcaatacttgcaaacggcaggtttaagtccaaatttttgacactaatccggtttccatgcatttggtagacctgattaggttgaatatctatatcggttttagcgtatagaagcattcctgctactgtatcgtttgaatctgacaggcgataagcctggtttttcacataggtaaaaatttggtatagattatttgaatggagtgtgcgcttatcaaagcgaatctgtgtgttactagaataatatttagcatcaataatcaatatagtatctttatatttgaggtaaatatcactctgcatgatggggagcatttctccaaaaccatcatctagtgcccaaggtatctgagaggcggtaacctgtatttggggataatgctttttataatatccaagaatgaacttctcatatagcaaggattccctccgctcatcaagaaaattcatcaatttcttattcccctccctctctgtatgaattaatccattcaccaccaaatagcagattgacattagtaattgatacgattgattgtttcgattgtattgtaaattccaattgattgagtgtagattaatttttgagacttctccaaagaaaactaagagttttctcaatttctttttcctgtccctgcttatatcagcttttagcagtatctcaatgcttgctttgataatgcgattcattctactgtcaagagaaaaatcatcgtattggcaaacaagttgctttctacgccaattcggaggtgttaaagattcagagatatttattttacctttaagtgccgagagtgactcggtttgagaacgatactctcgaccaagtcctcttttcacctgtatcgagaggctgattatcattatttccgccagtagatctgcagcatttttaaattcttcagtagcgatccgtttatattcctgctcatgaaggattttgaatgcgtaggatagcatatagtagatattttggacaggtatcactggatggcactccttaacttactactccaatcataaatttttgtcggttcatcaaaccaatattctttcaagaggggaatcagttcatattcaacaatggcttctagcaaaccttgttccagtacttctgccgataaaccgcagaagtaactatgcccaatacagaagctatctcccagtacttcctctgttgaaatggcctgatttagcttttctacacaggaaatgagtctatcgaatttttcgtttttcagatttgcttgataatctttgaatcccgtagttgaaaaacctggcttgatgtcaaagaaggcaaagcgtcgtctcagtgcataatcaagtagggccaaactcctatctgcggtattcatcataccgatgatatatagattttctggaattgagaattgctcatccgagtagaggagctgtaaagacttgcctcgtttgtcattttctatcagcataaacaattcaccaaaaattttgctcaaatttcccctgtttatttcatcaataataaagaaataattatgactcttgtcagactctgcttttttgcagaaagtatagaatgcccctcttctcagctcaaagccacttgtcgaaggcctaaagcccatgatgaagtcctcgtaggaatagctttggtgaaactgaattgtcatgaccctttctaaatctggtttacccattaatgaaaatgctaggcgttctgcaataaacgtctttccaactcctggcgctccttgtaagatgatattctttttcatttggagtatggaggttaattgatcatactcttcttctgtcatatagacttctgataggaagtgatttttcgtatagctatcttctactacctcttcactacctatctcgtttccagtatcagtttcatcagccagtggagaaattgttccagcacttctttccttctcttcttgattgatctgtttagagtatttccaagccatggatgataattctttaaaatctttcagtttgctctctgcactgtttaaataatgatgcatagagtccgagatataaaaataatcatcggcagaaatttttgacttcatctttggtaatttttggacaatgtcagttggaatctccccagactcatacacatacgcttcattttgactatctaagctcaagaaaaagtcgggagcaatccaatacaaggccatcgtaatcttgctgttgccatttcctttcttgtttatagccaaatcaaaatagtgtgaaaatttttctttcttctcagccgtaggctccttgctataggtcaaagcagcaatgaaaagttcccataagtcatcaatatcattctcatcacgatctccgataaaataatagaaagtcgcattctgattcatcagtactggtatactttcaaaagaggatgggatttccgtttggaggttgaataattctgctatagctgtcagaattttaatgcgattctcctcttttatttgcttattgaagagtccaaatatcgtaaaaggatcaatatctatcagtcgattgtccttttctaacgtgggcatatgtatctttgttttggtatagatagcttttactttctcaaccagctctgctctattatctttatagtctactaatttccaagcaaattccttataaaagtttacccaattgaattgattttgttcatccatagtatcctccaacggtgttgtatctacacctattaaattatgagttcgaatttacctatattttatcattaaacattcctgtcgtaaacttagaatttatatacttgtgtaacagtttaatgtggtaccttaaaatagtttcttttgatatttatatatgataatatatgactgaaagcgttttagaaaggtgtgatggctgtgctgaaatactcgaaagtgctgttacttgtcttgcttattgctactggtctatcttgtattggaatctactggctcggaaaagagcaaaatagactattaaatgagcagtgtcatgccttgaacatacgcattattaatgatctgggaacaaaaattgatgccattggcggtccgcaaaatccgcgtatcattggattctttcagcaagatgacactactgctatcagccagcggattggtacagcttctgaggaggaactgaaaatagctaaacctgacaatctattccagaaagagtggattgttctctatcctcaaacgcgcagcagtccctttgaaaatgcttctgcctatgcagtaatgaaaaccagtatcaaggctgactggctccatgtgactacttcgtcagagacggaattagatattttctatgagaaggcagatgaaagcttgttgaccttggaagacttggtgcaagacaaggaaagttttcgtgctacactaaaaacaatcctagtttcagctaaaaatgaggctgaaattcaagttcaaaaagatattttagaaatgttcgagagtgatgattggtctgctattccctttgcttacactgaaaaatctctgatattggagaaagtagatagtctaaatccctactatttttcagaacaaacccttgcggatttgcgtttatcagaagaatcgcgccaggctttagaagattcggtagataagacaatcatcacctatccttgaataaacggtgggagtgggaaagtcgtcatggatgtctttcccagcttctttatatctatgtttaacgaattaaacatttttgtggatttgaaaaatattttttgttatacttgtgttatgaaaacatcaacacttggaaagttactagaattaccaaattttcaccacttctacaccgttccaattagagaaaatacggagtcttctggaaattatataattgtttttgaacaggacaagcaacctgtatttgttgatttgaaaaatgagactggtcacactcgtgaggtacgctttgccagtcattttgacagcgccggtcttctggtaggattaggagccattcctatcaattattggtctacctgccagattcttggtgtgaagaaaaataataatcgacgagggcttagtctatctagtctgatggatggttatagacgtctacctatttttaaggaaatggcagagcgttatagagcgcgtggacaatcaaccatttatgacccctaccgttattcatatactattgatgaaaagaaggttattaaggataatcaattaacccttattccaaagaaagaatacgaaaagataaaagatttccatccttttttgcaaacaaagcatggaaatgtttatgcagttccttgtttctatcaagacagaaaacgaaatcagattactaaaatctatattatgggctggtacttttatgagaagcaattaaaaatatcttggaaaccttctcattctcgtaaaagccgctggcgttcttctcttgtttcagttgataaattatcggaccgcttcttctttcaaggagaattgtataaaaaaggaacctatccagtgttcctggaagatctcacaataaaaaataaggcctaccaacatcgcctagatagggagtttgcagcctttttaagcattattgaagaacaaaaacagagagcacagctccgtgttaagtagaaaatgggtaggttggtaaattaccgactatcatttttacgattatcttttagttttacaacgactcgaaactggcgatcaggatgattttctgtattggacatctgaatacgtgcctctagaatatcgccgtgtccaaaatagattaagcgactgattagtgagtttttatccgatgggatatatcctaactttgtgccctgataaaagattgctacagcttctgagtcatgtgggtttgaaggttctccgactagctgaacaggtgttcctggcttgagttggtcgattacatctagtccatcatagtaggcaaatgctgccaaatgaaaatcttgcacattgcgtgttggttcaaatgatgtgaatgtcacatctaacctcctagagaatcattatggttgataaacaatttgataatctgcattgataataacaccgttttggtaaatagtgtaacgggcattatcatcgccttccaaaatattataaggaatagattcggtgcgcgtgtagttaccttcaatgacgcgccaattgttttcgcctaaaattgagttggcataatcaatcgtttttggtccactatccaactggacgcctgtttcagtattttttaatgggtctataccgctagtggctgaattggtcaagcgataatagacatctaccacgtctgctgttgtttcttggcttattacaatcattctatcgcgcgtagagtcagtagtgtctgtctcagttgtatttgcttgtgttcctttgggaatcattaatagtgttacatcgccaatcgttgcgtctacatagcctgtttcaaaaattccgtcagttatttttccgcggccaagtaaggactggctatctgctactaatcctttgctattgaagactagtgaatttccttggctattttgccaggtgcctagtatactatcgtaattgccttgcattagagcatctatatccatagaactaagagaaatctcacgttggattgttgatgacgtgcttgtattggcattagaaacctgggtatcagcagttgaggtacttgcggaactgcccttcttttcagtttgacaggcagaaagcgacatgatagtgagcaagccaagagcgagtgctaaatattttcttttcattctagctatctcccctctaatctctatgaatagtaaagccagttgcctgtttggttgccataatggtcatatcagaaatctgcacatgtgcaggttgatttgcaacaaatagagtacagctggcaatatcatttgcttgaagagcatcaattccttgatagactgtcgctgctctctctttatctccatgaaaacggacttggctaaaatcagtctcaacgataccgggttgtaacgtagttaccttgatatttttatcaatcgtgtcaatacggatcccgtctgaaagcactttgacagctgatttggttgcagcatagacagcagctcctgcataggcgtaaataccggccgttgatccaatattgataatatgaccctcattattttcaaccatttgtggcaataactgacgtgtcacagttagtaatcctttaatattggtatcaatcattgtcatcatgtcagtcaaatcatagtcttggaatttgtccaatcccaatgccaggccagcattgtttaccaaaatatgaatttgaccaacttcttctaaaattttttgacaatttacaatcgtttgttccatattcgtaacatcaaatgaatgaactgacacctgaacatggtattgcttttcaatatcttgcttaatttcttctagtttgtccaatcttcgtcctgtaatgatgatattatcaccattagcagcaaacacataagcgattgctttgccaataccactacttgcacctgtaatcaatacatttcgtttcatcactctgtctcctattctctttattatactacaattttacctagtttgtaaaaatgctgtagttaaaaactcatcagatttccgatgagtttgataggtattaaaataaattaatgaggcgcatcaggtgcatattaaaacgaacctgtctagcatagtagatatttccaccatttacatataacttcccaccatttagcaaagccaagggatgaaaataggtatatgtttcttctgtagtattccctaagcttggtgctactactgttctggagtattctttagctaaagagagtgtatgttctccaccatgttcagcaatatagtcaatataggctggaccgaaattatatgcctgaactgctgtccaaacctctactcctttttcctcagccaaccgtaggttttctgtcaggtagataattccttgcctgatactctctctactatccgtgatagtgttagcatagccagtagcggactcactcgattgcatgacatctgcttcttgtcccttggtttctgtgtaaatcattgctaggactagttcttcattagctggtgtgtcgttttcagccaatacttcttgtaccatagtttgataggtcatcacttgcttgactgcattgtaggtttgatagaatttgtaaccgagaaaaatcagcaaaagaagtatcagcgtacgtatcagttttttcatttacttgctctttatgtcttcaatatttttgataagaatagaataggtcccgttgtcattttgaataaactcaaccgattctgcatcctcatagattgcatttggcacaatcaactcaattccgtttgataaagatagcttctgattttcaaatttcttaagttgacggctactatcaatttcatcgaaggaaatcttatcaggtatgacctctttcagttgatcgacgaaatttaaacgagcggtcaggttgttatcgaataactgatcagccaatttttcaggtgaaagctcattatcttcttccaaattgttgaaaatagctgacttgactttcgattgaaattgaaaatcgccttgatggaaattgtcagcaatcttctgtgcagtttgctctactgctttgattgatttttttgcagaaatagctggtgtaacttgcagaagattatctgagaaataattgaggaaggctccattgtgtttgattcttttctcaatcaaatgatacttccgcgtttgaagattgacaatcaaggcttcatcaggtgctgaacctgctccaggtaaattattctgggtgatttttaaaggacttccgctttccagaccaacgtgggcgagattttcacgcagtgagattctcaaaaaggcaaaatgttcaacaccatttcgttcaaactctatgaaaatgaggtcattggtttttaaattctcagaaattgaaaattcttctttccatagattagcaatcttgacagagttggtcagtaggtcgccatctaaatagtcaagaaaaggattgtcggggttaaattgtcctgtttttgcttcatcagaaaagacacgttcaatctttttacgcaaatattcttctatttttgggctaacagtcaaaagctggtcggaaaggaccagctctgtatcatcaggactaaattgatgtatgatggctttttttacaaatatatccattataaaccttcgtaaagtgggaattgatctgtcaaagcacgcacttcttgacggacttcctcaagagctttttcattttctgcattttcaagtgctttgatagttagttgtgcaaccttgcgagcttcctctactccaaaaccacgagcagtaatggccgcagagccaatacggataccgcttgttttgaatggtgagagtttttcgtaaggaattgagtttttattgagagtaatatttacttcatccaagagatgctgagcaactttaccattttcaacaactttggtcacgtcaacgaggaagagatggttgtctgttcctcctgtgatgactttaaagttagggtttgcaaggaagacttcggccatggccttgctgttctcaatcactttctgagcatagtctttgaaagctgggtccaaaacttctttgaaagatacggcttttgcagcaatgacatgctctaatggaccaccttggatgcctgggaagatggctgagttgattttcttgatgagctcttcatcattggtcaaaattaaaccaccacgtggcccacgaagagttttatgagtcgtagttgttgtaatatgggcatgtggcactgggttcggatgaagacctgctgctacaagaccagcaatatgagccatatccaccatcagtttggcccccactgcatctgcaatttcgcggaatttagcaaagtcaattgtacgggcataggctgaagcacctgctacaatcaattttggctgtacttcttttgcttgttttaaaattgcatcgtaatcaagcaagccagtttcttcgtcaacattgtaagctacaaagttgtaagtttgtcctgagaagctaactgatgcaccgtgagtcaagtgaccacctgcagctaagtccatccccataacagtgtctcctggctcaatcaaggccatgtaggcagcacaattggcctggcttcctgagtgcggctgaacgttagcaaattttgcaccgaatatttctttagcacgttcaatagctaaactttcaactacgtcaacgcattccgtaccgccatagtaacgacgacctgggtaaccttctgcgtatttattggtcaaaatagaaccttgagctgccataacagctttagaaacaacgttttcagacgcaatcaattcgatattattttgttggcgtttttcttcagcttggatagcttcccaaacttctttatcaaattctttgtagttaactttgtcaaaaatcatatacggtactcctttgtattgggctaaatgtgcttgataaaacgcttctgcattttatcggagtgatagccattcttttcgtagaaaagatgggcttggagacgactttcagcagaattgaggcgaataaaatggtagccctctttctgtgcaatttgctcaacggctttcagcaggcttgctccaatcccttgtccttgatgaccaggcaaaacagctagtccgagaatattgaggcctgtatccgaatagagactttcatagacttgtgcgtgaatgtaaccttgcactgcgccacttatgtcatctatatagaccaacaagatatgccccaatgtgctcgtgcatctaaaaaactgtcgctcagtttgttccaatgaacaatcataccctaaggattgagcattgatttctcggatgactatcaagtcacttttctcaatgggacgaatcataaaactacctcaaattctatttcgggaatggctttctgaatctcttcgcggctgatagcaccttggcgcaaaatccgcgctttctgtccagaaaggtccaaaatcgttgaatcaatgcctgttagagcttggtcatcctcaatgccaggcaaatcaactgaaaattgtgcctggatgtccgaaaacttcttgccactttcgtttcctgaaatattggcggacggtccaataagtgggccagtctctgaaatcaaacgtaaggtttgttcgtgattaggaagacgaaaaccaacagtatccagtccagaattaacccaaaaaggaacgttgtcgtttgctttcaggataatcgttagcggtcctggcataaatctattatacagtttctccagaaaaaagggtgtattttgactgaaaaaataaatatcgttcagatttgagacatttaagttcattgccttgtcccgcggacgctgtttcaactgatagacacgattgactgcatcttcattcaaggcttgggcaaaaagcccatagactgtttcagttggaaggataacagcaccaccattttcaagaattgttcggagtttatccattgtcatccgctacgacctttctatcctgtccaaattggtctttgaggactcgaatttgcttttgggggaaatgcagagcgagtaagtcggttaggtcttgcccttgcttgtagccaatttcaaagtagagttttccattttccttcaaaaatgcccctgcttgctccgcaatttgtctatagatagccatgccatcttcttccgcaaataaggcaagatgaggctcagaagtcaatacattgagtccaacttcatctgtgtcatctggtgagatatagggcggattagaaacaatgatgtcaaatttccctgtcacagcttgcaagacatccgattctagaaagtgaacagagacttggttggttcttgcattttcctgagccactgctagggcatcatttgaaatgtcaaccgctaccacttcccaatcaggtctagcttttgcaagggaaatagctatggcaccgcttcctgtaccgatgtctaagatacgcaaacttgctccgctattttcctgcaaaatcaaatcaactaattcttccgtttcaggtcttggaatcaagactcgctcatccaccgcaaactccaagccatgaaaatcagctttgccgataatgtactgggcaggtcggtgttgggaaagttgctgaaaaatcgcatcaatctcttctttgtcagtcggtgtgacttcctgacggagcaggaggagaaattccgtaaagttcaatccctttaagccacgaaaggtgaaggacagggattctgcctcttcaccgattgcgactaattgttcttcgtatgctgcaaataattgagcgtaattcattatttgttaagctcttctagtttttgcgtttgatcgtagagaacaagggcatctacgacttcgtccatcttacctgacaagatagtatccagcttttgcaaggttaagccgatacggtggtctgtcacacggttttgtgggaagttgtatgtacggatgcgctctgagcggtcacctgtaccgatagttgatttacgctcagcatcctgctcatcttgggcaatctgtgcaaagtgatccgcaacacgggcacggataatcttcatggccttttcacggtttttctgctgagtccgttcttcctgcatttcgaccttgatgttggttggcaagtgaacgatacgaacggcagtcgcaaccttattgacgttctgtccaccagcaccagatgcgtggtaaatatcgacacgaagatcttttggatcgatgtcgtattccacttcttcaacttctggcatgatgaggacagttgctgtcgaggtgtggacacgaccttggctttctgtcacagggacacgttggacacggtgagctcctgattcatacttgagttttgaataaacggattgaccagagaccatggcaaccacttccttgataccgccgacaccgttatatgaagcctccataacctcaaaacgccagccttgaccttctgcatatttttgatacatggtcaaaaggtctccagcaaagagggcagcttcatcaccacctgcggcaccacggatttccaagatgatgtttttgtcatcgttagggtcttttggtaaaagaaggattttcagcttttcttcgtaagcttctttatcagccttagcttgtttgagttcttccttagccatttcctccaagtcagcatcaccagaagattctttaatcatctcttctgcatcgacaatgttttgaagtacagtcttatattcgcggtaggctgttactgtatcacgagttgtagcttcttccttagacaactccataaaacgcttggtatcgctgactacatcagggtcagacaacaattcaccaagttcctcgtagcggtcttccaccgcctgtaattgatcgtagatgttcataagattaagatacaaagcccgttaagcaagcacagtcaaaataggaatttcgaccaagtgttacaaacactcggagaaattatctttttgacacagcttgtagggcgtgttcaattcctttctgtaatatgtaggtcatgaaacaggcacagttcgtagcccgtattcaattcctttctaaatatttgaccgcacacacttctagttagcttgtagggcgtgttcaattccattaagatacaaagcccgttaagcaagcacagtcaaaataggaattttgaccaagtgttacaaacacttggagaaattatctttttgacacagcttgtagggcgtgttcaattcctttgccgtagtatgtaagttatgaaaattggcacagagtcataggcaaattcagttctatatagttgctcagtttacagttgcttctcatttcattttcaaaaattagggtaaatctttaatttctggtgaaaaataatgtttgcgacagacaggaatgtaggtttcattgccaccaatttggatttgttctccttcataagtaggttttccatcctgtgttctcaaaaccattgtcgcttttttagaacaatattggcagattgttttgatttcatctaatttatcagccaataagagcaaatgttgggaaccttcaaatagttcatttcggaaatcatttttaagaccgaaagccataacgggtacatctaattcatcgactacgcgagcaagtgcgtagacgtgatgacgtcgaagaaattgtgcttcatcaatgagaacacagtaaggacgcggttccattttttcaataaaaccaaagatatccatatcatcgtcaatcgccactgcatctcttctcatgcctatacgactggatacaacaccaaaggcatcacgagtatcaagtgcagatgtcatgataacaacaggttttccttgttcttcatagttgtgggcaaccttcaaaatctcaatggtttttcctgagttcattgtcccatatttataatataattgagccacttttctctttccaatcttaaattttcactccctccattctatcataaattgaccatttaggaaatagaaaaacaagcccgttttgagcttgtttgatattaagaccatggtaaagagagaaattctccaatacatcggaaaatgattttagctgccgttggtttccacttgtagagcataacacaaccatatatcaggctgtaaaaagaaaatgcaagaaacaatgggccttcccatacacttttgttaaaaacagttactactagatacaaaaataatccagtgagtaggaacgataaaatcatacggtatttataggtcatgagcaatccctccttataagagtagtatagcacgcaatgtaaacgttgtcaatgttttttcttactcacacccaactccatctccatcacggtctaaatgactaccgtaacctggttctccatgatagattggtgcagctcctgcttgtctaactgccttacaatttggataatatgtgttttgagatggtgtagcagtaaattgctgaacttggctttgtgcttctgctactttttgcgcttcggcggcgagacgttcttcctcctctttacgtgctttctcagcaatagctttttcagcattccaatatttgacaatgactttgctatcttttttgatgaccttatcgttcatctcgttaaaagattttccatcaatctcgaccgcaatgatttgtccgtttttagcaatttcattggtctctgttgctacttcagatacttgagaaaaaccaccgtcggtaaacaattttttagtatctgcagctgttttcgttgaaatggatgatggcagttcagcgaagctagagaaatcgtagtaggtaattacaatgggggttgattttttgctgataatctcctgtttggtgggcaattgaatctctgcaccacctagattaattttttgaattttttcgtgctttgctttatccttgtctgcaacagcagtccacttgatgtctgtaaatcctgctgtttttagttgtttttcgagctctggttttgttttagcctctgctagattttctggtagtttgatgttatctttgctaacgtcaaaataggttaatgtaacagggagactagtagagtaaaaatgattggattgataggtgtgatttccgatttgaaggcgatcaattttatcttttttgtccgcattgccttcttctactagcagaacaggagttagttcgatttgcataaaacctgaatctttcagctctttctcgacatctgctaaatttttagaagctggtaggttgaattcaacggcatcttttttgggaacatggtaggagattgtaattgggatgttttttaaagtacgtccttccttccaatcttctccgtcaacagagacgagttcgacaagattgctttcacctatttttccaaattctaaatcagtgatttccaccccctgaatattttttaaacctgcttcctgaagatgttttacgactgttacatactgttgtccataaaggtcatctttttttggaagttcagcagtcattaattgtgaaccgataaatgttgtaagtaggacgccaccagttattcctgctgttttccgattaagaaattttctagattttttaattgacgtttcgctaactatctgagttgcttttttcttaaacataaatcattctccttattgtttgtcgcgatattattataacaaaatataaatatattttgttatatcttatgaaaatatccttggagaatcataaaaactatggtacaataaacgaaaaataaaggaggaaatatatgccatttgtacgtattgatttgtttgaaggacgcacagaagaacaaaaaattgcccttgcgcgtgaagtaactgaggtggtatcacgcaatactaatgcgcccaaagaagccattcatgtcttcatcaatgatatgcctgaagggacctactacccacaaggtgaaatgaaacgtaaataagagaaaacactcttgcaagaaaatgcaggagtgtttctttgtatcaagtttatttcttatcgtcttcatccatgctgagaacactgaggaaggcttcttgtggaacttcgacagagccgatggctttcatccgttttttaccagctttttgcttttctaggagtttgcgtttacgggaaacgtcaccaccataacacttggccaaaacgttcttccgaagagccttgatgtcgctacgggcaacaattttctgaccgatagctgcttgtattggtacttcaaactgttgacggggaatgattttcttgagtttgtccacgataattttcccacgttcgtaggcaaattccttgtggacgataaagctgagggcatcgaccttgtcaccattgaggagaatatccattttcaccaacttggatgaacggtattcagaaatctcatagtcgaagctggcataaccacgagtggacgacttaagcttatcaaagaagtcaaaaacaatctccgcaagtggaatttggtagatgacattgacacgattatcatcgatgtaatccatagtcacaaagtcaccgcgtttgcgttgggccaattccatgactgcaccgacgtattcctgtggtaccatgatttgtgccttaacgtaaggctcttcgatagtggcaatctttgttgggtctgggaattcggatgggttggctacatcaatcatttcaccgtccgtcatgttgacatggtaaaccaccgacggtgctgtcatgatgaggtcaatgttaaactcacgctcaatccgttcttggataacatccatgtgcaagaggcccaagaatccacaacggaaaccaaatccgagtgcctgcgatgtttctggctcaaactgcaagctggcatcgttgagttggagtttttccaaggcttcacggaggtcattgtacttgttggaatcgattggatagatacctgcaaagaccattggattcatctgcttgtagcccgctagtggctcgctggcaggattttctgccaaggttaccgtatcaccgacacgggtatctgcaacggtcttgatagaggctgcaatgtaaccaacatcaccagtcgccaaataatcacgaccgattgctttgggtgtgaaaatccccacttccgtcacatcgaaagtcttaccattgctcatcatctgaatggtgtcaccaggttttaccacaccattgacgatacgaacttggaggataacgcctcgatacggatcgtaaaccgagtcaaaaatcaaggcttgcaatggagcttcgacatcaccagtcggtgctggaaccttctcgacaatctgctccaagatttcctcgataccaatacctgccttggctgatgttggcactgcttcagaagcatccaaaccaatcacatcttcgatttcctgacgaacacgttctgggtctgctgctggcaggtcaatcttgttaatgattggcaagatttccaaatcattgtccaaggctagataaacgttggccaaggtctgtgcttcaatcccttgagcagcatccaccactaaaatcgctccttcacaggcagccaacgaacgcgatacctcataggtaaaatccacgtgtcctggtgtgtcaatcaagtggaaaatgtatgtctctccatctttagctgtatagttgagttcgattgcgttgagtttaattgtgataccacgctcgcgttccaagtccatactatccagcaactgggcttgcatttcacggctggaaactgtttccgtcttctcaagaatacggtcagccaaggttgatttaccatggtcgatgtgggcaataatggagaaattacgaattttctcctgtcgttttttcaaatcttctaaattcatgtttcttcctctacaagggtattactcctcattatatcagatttagtgataattttccataagaaaaacacctagaaatataggttattgttacgagtaaattcccaaagtaagttctagtcggtcataaaataagactgaaacaaggaattattgtttgattaaaggtatggagccattaattttcgatatataaattccagttaatatatcaaagagttaatttctgattttattacttgtcccacataaactcgatatatttttaatgaatttaataattacaatttttcatcatttaaaacgtaaattgtcagttcgtaataagcacgataacctttatcataactcccttgtctttccatatctactgacaagttcaacttttcccctctatcgattagtcgggaaacttcctcagaagcagttttagggatatagccaacaaaataaccacatacaagtactttaactgcatttgggtcatacttattatctggctcacgaactaacttgacatctgtagtttctccgccgtacgtcagacatcttaacaccctcattggctcaaaacgatcttccctatattgcgtacctgctacataaaaatgcgaaaaatatttgtacttagcaatgaattctctatttttattgatagcctcctctatagaatcaatctcatttttataatggctaattaatccatcacatctatccgattggaaatatgatgttactacatacatgaaacaaagaaataccataataacaagaaacatccctttgaatacaatgacagagaagaacagcatcgttatagcaaaaaacaaccaatttttacactgcttcttcataatccgcaagttctcaatctccaaaagtataccttcaatttgcttttcctgttgaataatttcttctttgataagactaatcgttgttccttgccccatggtgaataacctctctattattgctttttttcattataccactaatcagttttttcaccaatttatcaaagaaaaacacctagaaaactaggtgtctgctctgctattttcccagccaaagaccgatctcgcgttcggctgcttctgcactatctgagccatgaacgacatttgccacaattccctcaacgggcgctgtcgcaaaatctccacgaatagtcccaggtagggcgtttactggattggtagctcccatcatatctcgccaagatttgataatttctggcccttctataatgccagctatcatcggcccgctcgtcatatattgtactaattgcgggaagaaaggtttatctgtcaactgttcataatgttgactgattagctcttctgtcgctgtaaccatttttaaatctcggatttgaaatcccctgcgttcgatacgtgaaagaatttgtcctgcaagtccacgcttaagagcatctggtttgatgatgaagaaagtacgttccatgatttttctcctgaactgtttattagatgttacttaagatagcatcccatgcctgatcgtatccgtgacgagtctcagaagaaaagataacgaattgatcatttttatcaaaatccaatttctttttaatcatcgattcgtgcttattccactttcctcgtgggattttatcagccttcgttgccacaataataacaggaatttcataatatttcaagaaatcatacatttgaacatcatctgctgatggctcatgacgcatgtctactaaactcaccacaacacgtagattttctcgtgtcgtcaaatactcttcaatcattttgccccacttagcgcgctccgttttggatactttagcatagccataacctggaacatctacaaatcgaattttatcatctatattataaaaattgagttgttgagtctttcctggttttcctgacgtacgtgcaagattttttcttcctagaagagtattgataaatgaggactttccaacgttagatcgcccggcaagggcaatttctggaatgtcatagcccggatactgggcttttgaaacagcactgagcaaaatctcagcattatgtgtgttgatttccattttatacctttcataaataagggtagaaaacaatcagtttccaccctttatttttttatgcagtttctagtaaaggcttttctttaccgtctactgctgcttttgttacacgaacgcgtttaacgttatcttgacctggcacctcaaacatgacatccaacatcgtttcttcaatgatagagcgaagtccacgagcaccagttttacgttcaattgctttttctgcaattgctaacaaggcgtcctcatcaaagtcaagctccacgtcatcataagacaagagtgtctggtattgttttacaagagcattcttcggttccgtcaaaatgcgtaccaaatcctctgttgtcaattggtccaaagctgcgaatacaggcaagcgaccaatcaactctggaatgataccgaatttttgaatatcgtctgcaatgatatgttgcatgtatgattctttttcatcaatagcacgattattatgaccaaaaccgatgattttttcaccgagacgctgtttgacgatttcttcgataccatcaaatgcaccgccaacgataaacaggatatttttggtgtccacgtgaatcatttcttggtttggatgtttacgtccgccttgtggtggtacgctggccacagttccctcgataatttttaggagagcttgctggacaccttcaccagatacatcgcgggtaatggacacattttcaccttttttggcaatcttatcaatttcatctacatagataattcctctttctgcacggtcgatgttaaagtctgcagcctgcaaaagtttgaggaggatattttctacgtcttcaccaacataacctgcctcagtaagagcggtcgcatcagcaatagcaaacgggacattcaaacttttagccaaggtctgagctaggaaggtttttcctgaaccagtcgggccaatcatgaggatatttgatttttgcaaatcaacatcgttctcatcacggctatcttggaaattgatacgtttgtagtggttgtaaacggctactgctaaagcacgttttgcacgatcctgtccgatgacgtagttgttcaggatattgagtaattcttgtggctttggcgtatcggccaagtctgtcaaaacttcttctgccagttcctcacgaatgatttcctgtgctagttccacgcactcattacaaatgaagacattgttccctgcgataatttttttaacttcttcttgattttttccgcaaaatgagcaatagattagctcatgtgtatgcttaacagccatgtgtttcctctttcatatctcttatctaaataaaaatccataaatggcgtgaatactattgaccagattggtaaaagcattcagtaaaaataaaattgctaaaccaaaacgtttcttccgaaaggcttgaatcgcacaaagaacacaaatcccacagagaaatgctgtaaataaaccgaataaacttctctccatgcctaaccatctcttctttcataggtttttattgtaaaatcatacgggtttttctcgtcttttggacgtaaattggcgctttgtagctgaaatttctccataggaaatgctttcggaaaatacacatcgccattaaattgaccgtgaatatctgtcactattaatgtttcaatgtaaggtgcaaaagcagtaaaaatttgtcccccaccaatcacaaatagtgtctgctcctgtttgttataccaatctagaacatcttccacactgtgtaaaatggtaatacgttcactctctagttgataggttttatccgttgtcaaaacgatggtgtgacgattgggaagagcacgtttacccatgccgtcgaaagttatacgtcccatcaccatcgtgtgacctgttgtcgtttttttgaaatgagctaagtcagctggcaatgaccaaggaagtctatcaccttttccaatcaatccattttcatcttgagcccaaatggcaacaatctttttagtcattttctctcactttccgtcctatcattctatcaaaaaaacatgaaaaatgcacttaccaagtaggccaagcgcaaatttttatcatgttgaaactatcaccgactcctcagagatagggaagattccgagattcgtagaatgtgaatctcgctggtgctggaaagcccccctcatcttaaatcgctaagtcaaaattaagttgcggtttaactggcttcgaaagtctgagtatagactgttgaaggttggaaatagcaagaacgaagttcttcactgctaatccagttaaattgctaaatcgaattttaactgcggtttaactggattgtagtccaccaattcaaaatcttctgcccgaatatcaaagaaattggtaccgtcaggaacatttaagaccaaacgtggctcaacttcagatggtgtgcgacggagtaattcttcagcctgttcaaactgattgtcatagatgtgaagattgttgatgaaatagaaaaacttcccaaccttccagccaaaatgtttagcgatcatcatctgaagggctacatactgcatagcgttgatatgatgggctaccaacatatcatttgaccgttgagttagagttgcatccagataaatctccccatccactcgccgaacgtcaaacagggtctgaaaggcacatggcaaaagacccgcggattggtcaaatgcttcataatcccacaaagaaatcacattacggcggttccatggattttcctctaattgcttgaggatttttgaaatgatgtcatgctttttcacgatagccccatagcgttcaccgattgtgcctgttccttcaacttcccagtcattccaatactggacaccgtatttttcctgtaagacagacaggtcattggtctggtcttggtaaatccagagaatttccttgatggccgacttaattggaataggtctaagtgttgtaataggaaactcgcccttagacaagtcatactcagcaaaggcgcctgtaacgtacttggaattagctacatttccatccttgtaacgtgggcgagcattttctgaaaaaacgccctcttccataatcttacgaatgttttctttaaaaataatatctgctttagtcatggtcttagtatagcaaattctagcaaaaaactccagttttgcaccggagttctcatttgaaaaagaatgaataaaaattaaggtggaacaaaccagatagggcagttattaggctgaacaatataaaatacaaggcaaccaagagaacactcaacaatatctgacgaacatttttagtgtaaatagccgttggtaagctggctagtccgaaaaatggaatgataaaaaatgttagtttaaaattcacatttacaatatcaaaccattgtcctattggcaaaaatagcatgacgaagagaaaaattgcgataccatacaaaactagatttaatctttttagtaaagtcaggttcataaccactccttctaggggccaaatataaagtagccaataccgaatatcagaggaaatgagattattaagaagatactaatcaaaccagtccacaattttttataatagatagatagtataagaattagagcccccagtagagggagaatcaacatggttgctacgtttccccagctagacgggaaaaaccagtcacgaatccagttatcaaggaaaaaagcagataacaaaatcaataaaccaagaatggtcagatagttgattattttagacatgtttacctgtttcataaggtgacactcctttctctttacactttcattgtatgcttaaatactacatttttcaatatatgtatataaagaaaatgtgacagcggaattgaaaaaagcagagtttcccctgcttttaacgattatttcaagacgagtgatgctgcgcccaatacacctgcatcattaccacgtgttgccaagacaatttgtgtactttccttgatttgtgggaagctattttcagcaaagaccttgcgaacgccatccaataagaactctcccgcagctgatacaccaccaccaagaacgatgtaggcaggattgaggactgcagcaatgtttgcacaagcaacacctaagtattctgagaagtgacggtagacaatcaaagccaaatcatcgccctcttttgccaaatcaaagacatctttagccgttacatcttgcccatcatcaatcatttgtttcagttttgcatcgcctgcgtattgatcagcatagcgacggctgaggttgacaatacctgtcgctgaagcaactgtttctagacaacctttcttaccacaagtacatgcaaatggctcatcaaagtcaactgtgatatggcccaattcgccaccagcacctttgacaccacgaatcaagtttccagcagcgatgacaccgccaccgacacctgtaccaagcgtcataaagacaacgtttggattgttgtttccagcaccaacccattgttcaccgagggccgctacgtttgcatcattgtcaataaagaatggtaaaccgagcgcagattcaaactgctctttgaccaattgcaaggtcttccagttgaggttataggctccgataacagtgccagcttcactatccactacaccgggtgagcccataccaattcctaagaaatcgtcctttgtcaaaccatgggtttcaaatcgctgcttgatactgtcaataatatcaggaacaatatgacttccatcatctaaaatatttgtcttgatagaccatttttcttgaatttctccctcagtagtcaaaatggccaatttaacagaagttcccccaaggtcaataccgataatttttttagacataatcatcacctcaaatgtattttctttattataacacaatgcaaaggtttgcgtaaagccttttcaaaaatttgtacggataaaaattaattgctctatcgaaaaagatagagcaaaattaaaaattgaatatgtaagataaaccttccaatggaaaagagcataactgtcgtaaaattactaccttctttcgttccattatagagaaaaagagtagaaataaaggtaaatcccagagcaaaccccaccatctgcaagtcgtgataagactgactataaaaatacaaggtgcttgtcagcaatatcatggataggatagttaaaatcaagcgcaatgtattcatttttttggtctttagatagctaaacaaagccgctcctaaggtcaccaagagatagatgaccatatatgacatgacaagaactttcatctagccctccagtttgctcagatactcataccgctcatatttttccaagagcaggtcgtttttctcatccaattccttctgcaaatcggacaattttgtaaaatcactaccacaggtcagcatttccgcctcgattgccgcaatccgctcctccaagccagcaatatcctcttcgatggttgcccattcctgcttctcaaagtaggacatccgcttcttgttctctttgattttctcggttttctcctttggtttttccaaggaaatggcagagctggaagccagaaaggccttctcatccagatagtctgtgtagttgccaaagaaagtctctataccgctatcttcgaaagccaagattttattggctaccttgtctaggaaataacggtcgtgactaacggtaatgactggaccagtaaagccctgcaagaaatgttccaagactgtcagagtcgctatgtccaagtcgttggtcggttcatctagtaagagaacattgggccgttgcaagagaatcttcagcaaataaagtcgcttcttctccccacctgacaatttctcaatcagggtaccatgggtattacgtgggaagaggaattgctccaagagttctgcgatagaaaccataccagatgtcgtcttagcttcttctgccacttcctgcaagaaattgatgacccgcttgctttcgtccaagcccttgatggtctgagaaaaataaccgatacggatggtttcaccaatatctaccttaccgctgtctgcttgtaagtcgcctgcgattagattgagcagggtagattttccttttccattatcaccaacaataccgatgcggtccttgttttgaatgagcaggttaaagtcttttaaaatgggcttatcaggataggaaaagctgacattttcaaagttaatgacctttttaccgatacgagaggtttcaaaattgatttccaattcgctatcgtctatcttgttggctaaatcgcctttgaggtcatggaaacgattgatacgagcctgctgcttggttgcacgagcttgaggttgtctgcgcatccaagccagctcttgtttgtagagccgctctttcttatggcgaagggcggcatctcgctcgtcctgttctgccttcaagcgaacatagtcctggtaatttccctgatattcggttaagctggcgcggtccaattcaaaaatccgtgtcgccacattgtccaagaaatagcgatcgtgggtaataaagagaacagactttttagtatttttcaagaaagtcgtcaaccactcaatggtatcaatgtccaggtggttagtcggttcatccagcaagagcaagtcagcattgccaaggaggacttgggccaattggactcgtctacgtagaccccctgataactcagcaacggttttgttgaggtctgttagcccgagtttcgacaagacagtcttgacctggctttcaatctcccaagcattgagagaatccatctcagccatcaccttttccagtcttgcttgactggtttcatcgtaatgagataagagcagctcgtattcacgaatcagctgggtttcacggaggtcagatgaaagaacggtgtctaaaactgtcttgctttcatcaaaatcaggttcctgggtcagataggcgattttataagcatttttggtacgaaaaggtgatacatctccgtcaaaaccgatacgacttgacagaacatccaacaaagtcgtctttcctgtaccattgaccccaataatcccgatacggtcgccttgatggatgatgaaagatagatcagcaaagaccgttttatctccgacagatttagtcaggtgttcaacgataaaatcactcattctctaagattcctttcacaaatgtcataatcgcttgctcttcgttttccagctgtccttccacaatctggaattccacctctttgagtagttctcccaatactggacctggtttgaggtcaaatgccttcatcagatgtcctccattgacaacaatttcatgcttgtcgtggatagtcaaggcttggtcaatcttatcgattgctgcaaaatctgtaacaaaaccttgtgcctgatgaagttcctctaccaagtataagaattctttgccatacttgaaacagatttgcttggtaacaggtcctgcttggcggagctgataaatctctaccaacttgaccacgctgcgttggaaatcattgctggttttccattttttcaggaaggacttgatgttatcaatacctaggcagacaaagagcagggcccaagcttgttcagatgtcgaaaagcgaaactcttctgtcagacttgttagcatggcctctaattcatcactttttccagctaaatcaggcaagaaattgtaagccttggaatcaatcatagcgcgcaagccttttcgccaaaaatccgccatcaatagtttatcaaactcgataaagctacgttccaccgagattttttccaagagcggtgcggtttgcaccatagcttcaaaggtcgtcggttcaatctcaaagtccaaggtcgctgcaaagcgaaaacctcgcatgatacggagggcatcttcgttgaaacgctcagccgggatgcctacagcccgtagggtgcggttttctaagtcagtcatcccatcaaagaggtctacaatttgagcctcttcatccagggcaaaggcattgactgtgaagtcgcgacgtttgagatcctcttctaaggaacgcacaaaggaaacctggctcggcctacggaagtcgacatactcctcctctgtccgaaaagtcgtgatttcatactcctttttcccctctaatactagcaccgtaccgtgttcaattccgacatcaatagtccgtgaaaagatttgtttcgtttcctgagggtagctggatgtcgcaatatcgacatcgtgaataggtctgcctaaaatggcatcccgcacggagccaccaacaaagtaagcctcgaagccagctgctttaattttctctaaaatcggcaaagcctcctgaaactcagaaggcagattgtttaatttcataataagtgttccaaaccataaacgagttgtgagcgtttgactacctctttaatgccgagattgacaccgcccataaaggaaatacgatcgtaagagtcatgacgaatggtcaatccctcgccctgtgccccaaaaatcacttcctgatgggcaacaaggcctggcaagcgtactgagtggatacggaaaccgtcaaatgctgcaccgcgagcgccagcaatcagttcttcttcatccgctgcaccttgagtctgtgactgacggacttgtgaaatgagttcggccgttttgacagccgtaccactcggtgcatccttcttcttatcgtggtgtaattcaatgatttcaagatttgggaaatacttggctgcctgtgctgcaaattgcatgagcaagatagcgccaatagcaaagttaggagcaatcaagccccccaagcccttctcagctgacaaggctgtcaattcctcgatttcttcaggggtaaatcctgtcgttccaaccacaggtgcgaaaccattttccaaggcaaaacgggtgttttcataggtaaattttggcgttgtaaaatccacccagacatcagcttccagactggcaacttcttctttggtcttgaaaacaggaacaccgtctacttctgtttctgtcgcaaatggatctaccaaggcagccagactaagtgctgcgtcacctttgaccatctcaacagccgttgagcccatttttcctttgaatcctgcgataattaccttaattgtcatgcaaactcctattcaataatgggagaaataccaaaggccactgccccttctcccaagtgcgtaccgatgaccgaaccaaatgacacgattggtaaatcgctaccgacacctgcttcttccaactgccgtttaaagttttcagccttctgaggtgcgttggcgtgtatgatagcaatctgatactgtccttcggtcgtttgttcttggaggatttccaagaggcgtttaatggccttcttctccgtccgaactttttcatacacttctatcttaccctcacctgtaaaatacagaatcggtttgatgctcaaaagattgccaagcaaggctgcaccattggacaagcgaccaccttttaccaaatgattgaggtcatcaaccatgatgaaggctgtagtcttcccaatttcttggtccaatttcccagtaatctcttcaaaactaagtcctgcatcagcccatttgagaacattttcgaccatcatacctaaaggagccgatgtgattttggtatctggaaaggcaacggttaatccttcaaattcatcagccaaatattgaatattttgataaaaacctgaaatacctgatgacaagaataagccaagtgcgtgtgtatagcctttctctgttaatttagccagaatttcttctagttccatcaaactcggttgacttgttttaggtaattctttcgatgaagccattttttgataaaactcttcaaccgtcaaattttgtccttcgatataattttccccatcgatgctgactggaatacttaggacaaacaggtcatcccgctcaatactttgaacattcaaaacagccgatgagtcagttataaccgctaatttcatattaaaactccaaattcactcctggtgcatcaaaggcgatttcagtaacctcataagtcattcgttttaaaatgtccaaaagaggctctaccaaaacacgtttttcctcatcagtaaattcagttggctcttctaccaatcgatttggtaagtgaacggcctgactcatggcacctgaaatcacaaaatgatctagtacaatcataaagcgcaaaatggtaatcatagatgttcgattttctgcacgattttgctcaatcaattgaaagtcaactttcaattttgtttccggaattccgttctctttttcccacgcgtgattgcgggcatcaaaatgatactgattgacaaattctttatcgcgaatgatttccatttcaagactcctctaataacaataatactcacattataccataatcctcgtgaaatagctaaaaaaccttgccagaagcaaggtttcaatcaaaattatttagctttacgaagtgctccgtaaaggacacctgatacaaccgcaccaatcaaaacataggcgatgtaaagcaatggattagatgtcaaagcgataacgaagataccaccgtgaggagccatcaattggatgcctgacaaaccaaccaaggcacctgcaagggcagaaccagcgataaagcttgggattgcacgagctgggtcagcagcaccaaatggaatcgcaccttcagtgatgaatgaaagacccataacaatgtttgtcaaacctgagttacgctcttcttgtgtgaatttgtctttgaaaagaagggttgcaacgaatactgccaacggtggaaccataccacctgccattaccgctgccatggcaacagaaccaccatctgcaacagttgctgcaagtgtacctgtaccgaagacataagctgccttgttgactggaccacccatatcgactgccatcattccaccgaggacaagtccaaggagaatagcagagctaccttcaagacctgcaaggaagttgttcatacctgtgttgattgctgccattgggatgttaacgaagaacatcaagaaaccagtgattgctgttcccaaaagtggcaagagcaagatagcgttcaaaccttgaagtgattttggaaggttgcgcaaagcgttgcgaagaacgagcactacaccaccagcaaggaaaccaccaacaagggcacccaagaaaccagatgatacacctgcaagagcaagcgtttcttcaccaccagctgcgtaaggaattttaccgaacgcaagaccgctactagcaattgcaccagctacgaaacctgcaaccaaacctggtttttcagcaatcgagtaagcaatataacctgctagaagtggcaacatgaagccgaaggctgctccaccaatcttcatgaacatagctgcgatttcatggtatgaaccaagactaccaaggctgtcttgtggcacacctagagctccatcgaataggaaggcaagggcaatcaagataccgccaccgataacgaatggcaacatttgagacacaccactcatcaagtgtttatagaacgctttgccaagactgagtttttctgaagattccacagtagctgctccttctgacgcagtgtaggctgatgctttaccatccaagataaggttaattaattcttctggttgtttgattccagctgcaactggacgagataccaaaggtttgccattgaagcgaggcatatcaacagccttatctgctgcgatgataacacctgctgcattcttaatgtcttcagcggttagtttgtttccaacacctgaagcaccgttggtttcaaccttgatgtcaacacccatctcagcagcttgtttcttaagtgcttcttctgccatgtaagtgtgggcgatacctgttgtacatgctgtcacagcaacgataaatggacggtcaccacttggtgctgcaacaacttcttcagcagtcttatctgctgcttcagctgcgtcaaaaactgaaatgacttcttctgggctagacacaccacgaagtttgtcagcaaatccaggcttcatcaagtatttagacaattcagcaagggcagccaagtgtgtatcgtttgcaccttctggagctgcaatcatgaagaacaaatcggttggttgaccatcaagacttgcgtagtcaactcccttgtttgattttgcaaagagaacagttgcctcttttacagccgcattcttagcatgtggcattgcgataccgtcgccaagaccagtagttgtttgcgcttcacggttcatgatacctgttttgaaaacatcaaaatctgtaacatatcctttatcaaccaaactagcaatcatttcatcgataactgcttccttgcttgtcgcttgcaaatcaagcaacatgacatcttttctcaaaacgtcttgaattttcatagtgtttctacctcaactttttcataagtttccttaataaattcgatacttgccaaatcatctgaaaaggctgttgccgtaccgcaagcaactccccattttagggcttcaattgggtcttgtgagcgaacgtattcacctgtaaaacctgccaccatggaatctccagctccgacagagtttttcactgtacccttgattggtttagcaaagtaagtagctggtggagtgaccaacaaagccccatcccctgccatggaaatgatcacattctgagcacccatttctaagattttcttagcgtaggtttcaatgtctgcaatgccattcaattcgacgttgaagattgcttcaagttcatggttgtttggcttgaccaaaagtggctggtgtgctagtgagtctaggagtgtttgaccttcaaagtcacagacaacttgcgctcctgcttttttcgccacaggaatcagcctattgtagacttcgtttccaagactagctggagcagacccagcaaagacaacggtgtcttctttggtcaatcctgctaagaccatttctaattcggccaactgtgtatctgtcacaatcggacccaaaccgttgatttctgtttcttggtcagctttgattttcacgttaatacgtgtatcttgatcaacctgaacaaaatcagtatcaattccttcggcaatcaatccatctttgatgaactgacctgtgaatcccccaaggaaacccgttgctgtattcggatagcccaagcgcttcaaaacacggctaacgttaattcccttaccgccggcatacttatcgtcgctctccatacgattgacactgcccgtctcgacatcttctaaacgaacgatatagtcaatcgctggattgagcgtaactgtataaatcatacctcgattaccctcgttttctcttttatgatgtccaacaaactgctttctgaagattggcagataatgttggatttttcgattgccgcaactttaacaaaggagaattgaccaattttagaagcatctgccaaaacatagctttctttggcattgtctatgatagtgcatttgatggtcgcttcttcaatatctggcgttgtaaaatagtttttatcaataccattcatccccagaaatgctttatcaaaattgagctgtcgaatttgttccaatgctactgctccaacggaagcatctgttgattgcttaacaaaaccacctataatgattgtttttatcttgcgttcaaccagcctcactgcgtggtgaatagaattggtaacgactgtcagattttcctgctgaagataatcaatcagtacaccggttgttgtacctgcatctaaaaaaattacgtctccgttaacaatttgtcgagcagcactttccgcaatctctcgtttttcttgaacgtttttgacagatttttctagaatagactcttcgagttgcaaattccctggcgcttcagcaccgccgtgtacacgacgaagcttaccttcgttttccaactcatccaaatccctacgtacagtagactcagatgtatcaagaacttcgattaattcctctagccgaacaaactgttgagagtgtattcgctctaatataatctgttttcgttctgatttgagtatgttcaacacctcctgcaaccgtttacaaaaatcattatacacgattttctgccattgtcaatcattttctatcattttctttcaaaaaacaaaaaaactagcagaatttacgcttccactagtttctcaatcatttttttcatcatgtccatttcttctggacggccgatagacaggcgaatatgcccttctaatttacctgttggataatatttgaaattccaatcctgtgccaaggcttgctgataaaattcttctgcccacgttgctttaaacgttacaaaactagcctgactaggtagaacttgacagttatctaacccttgcaagaataaaatcatttcttctcgcaaattctgaattacttccactgtttctaaaaccttatctgtataattcaatgcaacggctgccatttttgcagtcaagtttgacaagctgaatgggggaatgaccttgtccaattcataaattaactcttcgcttcctaccgcaaagccaactcgtaaacctgcaagtccaaaagcctttgataaagtccgtaaaactaaaacattgtcaaattgttgcagacgactgatgaagctttcgacatttgcaaattcaatgtaagcctcatctacaacgagtagccctttaaaagaaatagccaatttctccaaatcttctagtgaataagctactgaagaaggattgttaggattggaaagcatgattatctttgccttcacctcctccgcacgcgccaacaatttctctactggcaggacgagtgtatcgtttttttcttctaaatcaatggcttcaaaacggctaccatgcatgtgattataggtttcatacatgaagaagtctggattgacagtcaaaaaagtatcatccttttccataaaggtggaaacaatcatgtgaataaggtgatcagagcccacacctaccgtcacttgtttgggattaactccaagataggtcgcatatttctcaatcagttcggagtaagtgttatcaccataaaaacttaattgattgacatccaaattttccaaagtctcttgtggcaaaaaagcccaatcaatgatacgattttcgttatttcctaaatcaaatcttgccttttgtttgattttataaggttggtaatgttcaaataccttgcgtttcatcatttctccttctagcaagaaaaacacagtctaatcaactgtgtcttctgctttgattttttcaaaaatagttaactcttcagctgtaaagttgtagttttctaacaagtctggacgacgttgataggttttgcgtagactctcttccaaacgccatttacgaatattttcatggtgaccgctcattaatacatctggaactaccattccacgatactcgtatggtcgggtgtattgaggatattccaatagccctgatgaaaaactatcatccgtatgactgacttccttgccaataacctctggaatcaggcgaacggtagcatcaatcatggtcatagctgccaactctccacctgtcaggacataatctccgagagaaatttcatctgttactaaggtcttaatccgctcatcatatccttcatagtgaccgcaaatgaaaatcagctgctcttcctgtgccaattcttcggcataggcctgattgaaagtacgcccagcgggatccaataggataacacgtggcttggtttgttcaatgctatccatggtatcaaaaatcggctgggcaaggagcaacataccttgtcctccgccatagggttcatcgtctacatggcgagccttttcagcattctctcggaaattgtggtagttgatttctagcaaacccttgtcacgcgccttacccacaatagagtgttctagaggtgcaaacatctcagggaagagggtcaaaatatcaattctcatcgtctaggccctcgagcaattccacatcgacacggttatttggaatatcaatgttcaagacaacaggtggaatatatggcaagagcaggtctttcttaccttttcgtttcaccacccagacatcattggcacctggctgcaagatttccttgatttgtccgatcagaatatcattctcatagacatctaagccgataatttcatggtaataaaactcaccatcttcaaggtcggtcaaattttcctcggcaattttcaaactaaagcccttgtacttttcaatatcgttgatatggtacatgcccttaaacttaataatatcaaagttcttagccttacggtgactagcaatttccacttccatggcaaactgatccttgtcatcaaaaagtgcaagctttgccccttttttaaaacgttcttcagcaaaatcggtcacagacaaaacacgcatttccccttgtaggccttgcgtgttaacaatctttcctacgttaaaataattcataatttctccatttgattttctatccttttattttaacatgagcaagatattttcacaagagagaaaaagccggatgcctccgactttcatagttaatttatttcacagacaaatgagaatgagctattttgatcaagcgcaaattgagagctattccgcagacaaaaatccctgaaataagaccgatccaataggcttctggacccatttggaaaaatctttcaagcaagaatgcgactgggaaggtcatggaccaataggcaaccaaaccaagtataaatggaacagtcgtatccttgtaaccacgtaaaatcccctgaataggtgctgtaaaggcatctgctaactggaacatgagggcaaagctcaggaaatgcgaggtcagacggataaattctgcgtcattaccataaaggtaggcaactttggagcggaaaaaatataggaaagttagcgtcaaacctgcaaagcctagtgctactaagcgtcccagacggctgtaggctttcacatcttgtggtcgtttagcgcctacttcataagcaatgacaatagctagggctgaggataccgatatggaaaggcatataataaggttgcaaagttcatagctgactggtgggctgctataatctgtgctgaaaattttgccatgtagagccctactactgcaaaaattgctacttctgcaaagacttgtaaaccgatgggaagaccgattttcagtccttctttcagtaaagacccatcaatcggactccaccgccaaatctgataagaagaaatagtcttatttttgcacatgacaataacgattactagcaataccgcccagtaagctaaagcagtacccaatccagctccagctccgcctagggccgggaggcccattttcccataaattaagagatagttaaatagactgttaaatgggacaaggagcaacatgaggtacatggatagctgagtcaagccgagggcgtcgaaaaaagagcgacagacactaaagagcaagagaggcaggataccaatggaaataaaatagaggtactgccgaccaacttgaaaaacagattcatcaagtccaaactgagccaagacgggaacagcgataaataggatcgagcacaagagtaaaatggttaatccaatagatagatagacaaactgatgaaactcttgtcgaatctttgacttctctccttgtcccaaatattgggcaataatcgagaccaatgcagatacaatccctgtaagaaatgaaaaaagcggattccaaagacttgttgccatggaaacacctgccaaatccatagtactatactgaccagtcatcatggtatcgataaaggatgcggagtaattagcaaattggtaaattaaaatgggcaaaaatattttgataaagagccagagcttctctttgttatttcttgtttggtacatacttattctctttcaattttatataaatattgtaacaagaaaaggacctgcattgcaagtcctctttgactagatagagtcaccattccagatagagtttttcacgataacatagtccacatgcttcaagctggtaatgtcacgtcctcctgcataagaaatagatgactgcaaatcttgctccatttcaaccagagtatcttttaaatgtcctttggcagggagtaagattttcttaccttctacgtttttataagcacctttttggtattcagatgctgaaccgtagtactctttgaatttctcaccatcaacttcaattgttttacctgggctttcaatgtgaccggcaaagagcgaaccaatcatgaccatgcttgcaccgaagcggatggatttggcaatatctccgtgggtacgaataccaccgtccgcaataattggtttgcgggcagcttttgcgcaccaacgaagggcagccaactgccaaccacctgtaccaaaaccagtcttaacctttgtaatacatactttacctggaccaataccaacttttgtcgcatctgcaccagcattttctagttcacgaactgcttctggagtaccgacattacctgcaataacaaatgtctcaggcagttctttcttgatatgttgaatcatcttgataacactttctgcatggccatgagcaatatcaatggtgataaactcaggggcatcagctttcaagctagtcacaaactcatattcatattcttttacaccaacagagatagaagcaatcaaaccttgctcgtgcatgcgtttgataaatggaatacgaccagcttcatcgaaacgatgcatgatgtagaaataaccatctttggcaagcatttctgccacatcttcatcaataatagtctgcatattagctggaacaactggtaatttaaagctatatttcccaagagtcactgttgtatctgcctcggaacggctattgatgatacatttatttggaatgagctgaatatcttcgtagtcaaaaactggagtttcgttgaacatgcttctacctctttttcttaacattggaacagaaaaacggtttgtttttcgtattttttccttattacaagatatagtatagcttattgtttgtgttttgtcaataaaaaagaaacctatataaacaatattcggatatatcactttttaggcttgtttataaaatataacattcgtataattcttttctgagttattattcttataaaatttaaaaaaatgttcagaatttactcaaacaattttacataaaaactaaaaaaatcttcaaaaacagaagattttttagtcaaattcatataattgtgggaatttttcgcattcagggttcttaggatggcaaacctcacgaccaaaataaatcatagcttgatgagcagggagccagagttcaggaggtaagacttccatgactcgtttttctgtttccaggggtgtagctgattttttgacaatatcgtggtgtttacaaatccgtcccacgtgggtatcaactgcaaaggcgggaattccgaaaccgacacttaagacaacattggccgtttttcttcccactcctgccaaggcttctaattcctcacgagtttgagggacaatgccattatgccgttccatcaactgctgggcacagtcttttaaaaactttgccttgtttcggtacaaacccaaacgagaaatataaggctcaatatccttcacttctgctgccgccatggcttggggcgtagggaaagctgcgaacaaaccaggtgttgccttatttaccgcagcatctgtagtttgagcagataagagcactgcacataccaactcaaagtgatttcgaaagtccaagctaggcttagcatcaggatatagagcgatgatttcttcaataacttttcttgcacgtttttttgataataccatgaattcattatagcatgaaaacttggatttatctaaaatctggattgtcataaacctcattcctcgtggtataataaaaagaaaagggggaatatgtatggacttacaagaactctgtagaaaggtcattcaagcaagaccacgcaacagccataagggaagctatggtcgagtcttgctgattggtggactgtatccctatggtggagcgattatcatggccgcactagcaagcgtcaacagtggagcaggcttggtaactgttgctactgaaaaagataacataccagccttacatagtcatctgcctgaagccatggcattttcatttgacgatcaagccttactgataagtagcttagaaaatgctgacttggtattgattggtccaggttttggggaaaatagcagagctgaacagttattggactttgtttttgaacatttatctgaccagcagattttagttcttgacggctcagcccttaccttagtcgcaaagcaaaacagaaagaacttcccgtgtaaacaagtcatcctgacaccccaccagaaagaatgggaacggttatcagccattccggttgctgaccaaacaagccaaagaaatcttgaagccttgcaatcttttcaagaaaatacaatccttgtagctaaaagttccgctactcaaatcctaaaaacccagccaaaccaagtcaccccaataggagctggtggtccttaccaagcaacaggaggtatgggagatactcttgcaggtatgattgcaggatttgctgtacaatttccccttgttcaactatatgaaagaatccttgtagcaacctacctccactcctatattgccgaccaactggctcaagattattatcttgtaaagccaactgatgtctcaagaaacatccaaaagacaatgcttcaatttcaaacacaaacaaccgcctaatcaatgattaagcggtcttttatataacaaactcgtgattaaagcctgacaaatggtagaaaatgatactcaatgcaaatcaaaagtagcctaggaaacgaagccgaagatagaactggagttcatcatggcaagttgacaacggataattttgattttcgaagagtatgactatattttcttagacttcttctttatgacgtcgtttgcttaccaacagagtccctagcccaataatgacaccaagaacaagatagtatctcgtatcattgtctccagtatttggtagttgagttacctgtttttcttgattagggctagatagactagcttgcaaagtgactggacgaggtaaagttggttgagggtttggcttctgaccgatcgatacatgccctgaattcccagtatcttttacaggaggtgcctgtacatcaactttttctgagtctataggtggaggcgttacagtgccttcatcttttttgtcagtggcagtatttgctggctctttggcatcatttgttgaagtagcaataccattcagttctgcctgcgcgcttgtcagaacggctagagcttgatcgacacttgcttggcttgcagattcatcagctagaatcgctttcgctgcttcaactgcctggtcataagcttgtttcacgttttcagatgcattgagatacttagcatctgtcgcttttaatacggaagaaacggatactgcgctacgaagggctgaaatatcagtcttttgaccatctaagttggctttcgccgctaacaagtccgccaacgcttggttgacaactgcctgtgttacattctcttggttcaatacaagttgtgctgaacgaacagctgtatcataggcaatttgtttggtattttcagcattgtaataaataaagtttgcctgagtcggtgtgtagtttgatacttcagcaattagtttttccttatcggtagcctgaccgtttagctgctctctcgctgccacaagattggcaagtgctgaatctacttgtacctgattgtgtttgttggcatatactgcattggcatcttctaatgctttagcataggcagtttgaagttctggactagcattgtaataacgcgctgtttcttcaagtcccgcaagttcagcaatcagttctttcaaagcaactttattaatcaaggttaatttcttaacatttgactggtttgcaagtactgctacgtctaattcttccaaaaattcatagccttctgggagggttggaaggatagtgtaggtaccaactggtacaaatttaccataatcggtcttagaatatttagcatttggtagctgaatagtctggccatcagcagttaccagttggatggttgaaccagaaggtagtaatgcatcaatatctaccagcaagttggccttatctttcaaagtcacatagaaattcacctcggcagtgctattttcttccgaaatcgtcacgactgctttggtttcacctgctaggcttgaccattctgtatcatataagaataaatcaaaggtgtaagtaccaaatggtagcttaagaacgctagtatcgccggcatatcgtggtaattctgcaacaatcttgcctgtttcatcggtgactgagtaagagaaaagtattggtacaggactatttgtatctttatcaagaatattgacagttaccaaccctttttcattgccgatactgatcagattctctactttttcatagctgatgttaccagcataatcctctactgtgtagtagaattttgaaatatctgcaaggtcaagaggcaatgtaaaggagccatcgtcgttttgtgccacaaataccttgttatcagaaacggttacatcaccattttctaataaggaaggaatagttgtcacaccgcttgcatccgctacaaggtagaatacttgctcgcgatatagaccggattctcctttttcaatggctggacgagggttaaatgtaaagtttgtttcatcataggtagctgtggtgataactggtgattctctatcaatgataacgtcgaaaatcatagtttgtactgctgcacctggaacttcagatgagtaggtcaaaacgtattgatacttaccatctgctaaagcatttccctcgctgtctgtcccattccattcagtagggtaaataatgcttgattttggatttttaggatcaccactatagaagttcttattgcctgactgtggttgactttcccaaagtggatttgttcgttcggtatcatctgcagcatagacgcttgcgactaaatccgtataatttctcaagaagacacctttcaaagcgagcgaatcttggttgtcatccccatttggcgagatagctaaatgaggcttaccagactcatcgagctctaaaacaaagtatcctgcttcatttttaaatgtacctagagtcttgatcgcaaagtcagatcgtttgtctgtagaatagattaactccgtacttcctgtaacaagacctgtgtagtgatggctgatgtcaacagtatctggttgtgctgtaacaggttcaaagtagaagccccccttaccatcggcaataagattgtaaatcggctcttctagaacggctagattttgaattccccacggaaaccaacgtatggaatgctgacaatatcaccgacatcggctacatctgtaaatcgaacaaaaccttcaagatagtaaccgtttttcattaaacctgtcaattcttctgcaaagcttgctgcatcgacattaattgtaacagttgtacttgaattggctttcacagtcaccttaccgccaggaatctctgctaatagacacggagccaaggtaatcaatccgttttgaacagtatccgttgttaactgtgttgagtagtttaaagtcttatcttcgtttgtaatgttatgaagtgtgaccgtaaagctgaatatatcctcaacatttcccaaggtaatgctgccataaccgtcttcgccagtcaaatataaacctgtagaaatagctgccgcagtatcgatgatacctgcaccttgttggcgaggggaagtgtaggctgttgtttctttgttcacatgtgctttagcagtagacataagcaagtgttttactaaggcttcgatttcttgaggggacttagtagggtaagttgcctgtaaatattgttttactagtacggctgctcctgctacgtgtggtgaagccatacttgttccctgcatgttggcatagtcattatcattgatggctgcataaatagcaccacctggagcagctaagtctggttttagctcgccatccgctgatagaccccaacttgaaaaatctgaaagaagacctgcttctgggttagggcgaatatctgtttcgttattgaacgcaatcttatatgagttagatgccaaagcttcaccaaattccaatggaatgaagatagatggaattgcgatagctgtatcatccagttgcatgctcacattggcttcacctgggcggctattgaaaataacgacccctactgcccctgcagctgttgcattggctattttttctgagaaactgatggttcctcgtttaataagcgcaagttttccaatcaaatttaaaccatcaaaatccgaagcctgaccgattcctgcatagacatattcatattccttcccaatttcaaatgatacaggacttttctctggattatcgaacgaactcttaccgtaattcaaatcagcattattttctaagccaatgatattaattactttactgccaaccgttgtgttattgtaagaagcgacagaaattgcatcgcgagctgttgaaggagctccgaccaagccataatctggataatcggctgacggattagaatgacctgaaccaaatgttccatcattaccagcagcaataacaacagaaacacctgcacgacgagcagcctcgattgctgcagtcacattttcattcatgttaacaacagagccgttagctcctcccaggctgaggttgatgctatctgcacctaattttacagcatcttcaatcgcctttacgtacaatgctgcgcctgttgtagctttgaggtctgagaatacacgcataaacatgacttgcgcttcaggagctacaccatacattaattgtccagcgactggttgtgtcggatttcctgtggcaatactcgttacgtgcataccgtgtgaacgtttgtcttcttctttcaagacagtattcacatcaacatagttataaccaaatacaaccttatcgttaaaccattcgccgtaggtaattcctgctgcttctttagctgcttctatctctttttctgatttatattttgcggttgagagatctgaaatatgcaatacatcgtggtcaacgtcaagacctgaatctatgattgcaactactgttccttcgcccttgtaaccactatcccaaactttaggtactgtaatgattgtattactatcaatgttttgtggtttcgcttcttcctgattagtaatagcagtagtctcatctgctacggcaagcttctcctcttcttctacttttttctctgaaatagctggagtttctacagctggttgagtcgcttctacttctgtatttgtgatgttttcaagagcttctgagccaagtgtttcctctacattatctgtagtggttacatcagttggggtagcctccacagaagtgtcaactaactcctcgacaacgggactttctgaggctgattcgctgacgattacgtcaggaacagttgcttccaccttagtctctacaaggcttgtcaattcatctgcagctaccgatggtgcacctgcaaacaaaaaaactgcacccaaaagaacagacacagttccaattttatacttccgaagtgagaaagtttctttctttttcataacttttcctcctagtttttctcctttattattggcaaagccaataaatatattaaaacataaaattatcagcattgcaagtatattctgaaaattcagttatttattcaaactataactagctatcaataatatctataaccatagatacagataatacacactaaaaagggagtgagtaagacatccatgatggctccgtccttacccacagaataatgagaatgagcataaagccctcactaagattatatacctagtgagggccttgtggttggtgcattattgatgttaattatgatgacaaaactgctccaccctactgataagaaccacaatatgcgctcaagaatatgactaaaattcagtagataggctctctaattttaagaaggaaagaattgtcatagtaatcatgtgtagatcaagtcgatattgtcgtttgtattcccctcaacttgtccaaagcgttacttagctacatttgatacaacgactaaaggtctacgtgcttaccacgattttctcagtcaatttcatgtagaagctgttggtatggaaagcacaggtgtctattggcgacttgtctggcatgctctatgtgatgacttcgagctaatacttgctcaaccagcccacatgaaggctattccaggtcagaaaaccgacaagaaggacgctcactggattgccaaattaacacggattggtctgcttcctcggagtttcgttcccgatgaaaccattcaagaattgagggagttgaccagacaacgaaaacagtataatattgggacttttctcatctctttgttaagacaatctaaaaaatgctaatctccctcaaatatcctacgaacggtatgaatttgagagattggaactgcaacgagcaaggaatcccccatagaaagttggctatttcctttcacaatccttgacttaccgtgatgaatttgactggtgatcaagcatgaatccggcaaacgtaactcgctaacaaatcttctgtccaatgtttcgttgacaacaacctctattaaggtcatgtgttcttgctgttctacttcttctggcagaattttttccaacattgcttcatagactggcgcgccacctaagaggtccatcatcacataggaactcaaagctaccaacccgatgaccatcaattggttcaaacttccaaccatttcagttactaaaataatagcagttagaggtgctttggaaatcgctgcgaaaaagcctgccattcccaatacaataaacaatagcatctgctcctgactgatgaaaccaatatcaaggaagaaccgtgcgacaaaaagcccaaggagacttcctaaggttaatatgggtaaaaagatgccccctggtagaccagaaccataggaaatcatgctccatacaaatcgtattaaaatcaagattgccaatgtcagtagtccttgttccaaatatggaagctctaaaatcaaatgatgcccgccacccaacagattagggaaaaaataaccaatcggtataataaacaaaaaggcaaatacactgtagtatggaactgggagaggaatgatttttgagaggagggtatagaaatcttgtatattgaggataacaatttcatacacatatccagcaaggccaaggaaaactccaagtaagatatagatccaatattggtcaagagatagtaactgtaagtccttcggcatatgcaaaacaggcattaatccaaaaacatgtaaggaaataaagttcgcagtgatactggctgccagggcggagacccataccagacgtgaaaactgatgatagacttcctccacaacaaataaaaggcctgctattggtgcattgaaagctgctgccaaacctgccgcagcgccactagcaatcaaactccttctttccatttcactggatttaagaagaactgatacacctttagccgttacagctcctaattgaatactgggaccttcacgccccagcattagaccagatgcaatggataaaacaccgccgataaattttctccaaaggactgaccaccagttcaaatccataattccttttagttctgcctccacctgaggtataccagaaccttttgcatttggctcgtctttgatcaacttgccaacaagtaaagctatgaccagataaagccctccaataagaagtaaatagattgcattgtctgttgccagagaatagaggtgcgtaaagacagaaaatagtttttcaatggctaagcgaaatgcaacgaccactaaaccagcgacaatgccaactaaactaccacgcagaaccgaatagaggattgattgagaaataaaactaacttctttccggtgattttccattgggatttcccttcctttctatagtatgcatgaccaaaaaataggagcaataagtacttagtaaagaacctcactcccattcttttatttatattgctacctgtccaatcagactatttccgatacatcttgaattggagatagaggtcattatacattccaagcatctctggtccaagattatcataaacttccatcttcttcatcgtttcttctgaaggatagaaggattcgtcgttctgagtctcctcatccagcatagccttggctgcaggaattggtgttgagtagccaacatattctgcattgcgaagcgcattttcaggacgaagcataaaactcataaaggcgtaagctccatcaatattttttgctgtttttggaatgaccatgttatcaaaccacaggttagaaccttttgatggtacaacatagcgcagattttcatttccatctaacatttcactcgcctcacctgagaaagaaacagcaattgctgccgcatcttgtatcatataaccttttatctcatcagcaacaattgctttgacatttggagttaaattataaagatgttcggctgccttttcaatctcggtaggattgttagaattgagactatagcccagtgattgtagaccaaagcccatgacttcacgcacaccatcaattaacatgatattgtcacggtattcctctgaccacaagtcttcccattcctgaggaggattttctaccatggtttcattgtaaacaatgcccaaggttccccagaaatatggaatagaatagtcattattcttatcaaagctaaggcccataaatcgtggatcgatattttctatcccttcaatcttagacttatctagcttgattaacatattttcttctgtcatcttagaaatcatgtactcagatgggattgtcaaatcgtatgttgttccaccctgcttaatctttgtgtacatcgattcgttggagtcaaaggtctgataatctacctgaatacctgtttcagcagtgaattctgcgagtaattctgggtcaatataatcgccccagttatagatgacaagtttatcagttgtcccttgggttgaatcagcttctaacttataactaattccccataaaactaggacaattgctataattcctacaaaaaatgaatacaatcgtttcattagttggcctccttttcacgtgagatgaaataataacccactaccaataagatagagaaaaggaaaactagggttgacaaggcattgatttctagagaaatcccttgacgagcccgtgagtaaatctctacagataggtttgagtaaccatttcccgtaacaaagaatgtcacggcaaagtcatccaaggaataggtaaaggccataaagtagcctgcaatgatggctggtgttaggtatggcaacatgatttctttcagcatttgtggctgagttgcccccaaatcataagctgctgaaatcatatctgcgttcatctctttcagccgtggcaagaccatcaatactacgattggaatagaaaaagcaatatgactgagcaatactgagacaaagccaagctggaaaccaatcatggtaaagagaattaggaaactcgccccaatcatgacgtctggagctaccatcaagatattattgacagacaagagtgcattttgaaaacgaggttttgcctgatagatatagatggcaccgaaagttccgataatggtcgcaatcaaagaactcaagaaggccaacaagaaggtttgagccagaatcagcattagtcggctatcgccaagcatagatgaaaaatgctctaaggtaaagcctgtaaagccattcatatctccgccttcattaaaggcataaaaaataagatagaaaatcggtaagtagagaaggagaaaggcaactgttaagtagatatttgcaaatttcttcattatttcttcctctctttcgtcatccacataatcaagagcatggccaaaatcaagaccacacctatggttgaacccattccccagttttgtgttgtgagaaagtgttgttcgatagctgtaccaagcgtgatcactcggttgccgccaatcaaacgggtcaacatgaagaggctcagacttggaatgaaaaccgcctgtacaccagaacggacaccattcatagaaagaggaaaaataacttttgtgaaggtctgccaaggagttgcccccaaatcacgactggcattgattaggtttttatccaaatcatccaaggcgttaaagatcggcaaaatcataaacggaatctcgatataggctgcaacagcaataaaggagaaatctgtgaaaagaatttgctgagctcctagaccaataaattctaggaactggttgatagagccgtgttgtccaaaaataccgataaaggcataggctttcagcaaaagattgacccaggttggcaagataatcaacatgagccagagctgtctatgcttgagtttggtcaagaaataggctgttgggtaggaaaccaaaagcgtgaccagagtaataatacctgcgtaaaaaatggagttaaaactcattcgcagataggtcatatttggcgagttaaaataggtctggtaattggccaaagtgaaatcgccatgaatatcaaagaaagatttgaagataatcaaggcaactggagcgagtacaaatagaaagacccatagggcatagggaattgcaaaaagcctagaggttttcttcattgcgttcctcctcaatggcgttaatcaagccatcttctacttcttccacttccacatattcttcgatacgggcatcgaattcttcctctgtttcattgagacgcatgatatgaatatcttctggctcaaaacttagtccaatcacttctccgacaatggccttacgagttgagtgaatcatccactcattaccgaggtcgtcataggcgatgatttcatagtgaacccctcggaagagctgagtatccacttttacctgcaatttgccttcctcaggtagggtaatctgcaaatcttctggacggataacgacttcaacttcttcattaggacgcataccgccatcgacagcttcaaagcgtttgccgttaaactcaaccagatagtcttctatcatgcgacctggaaggatattggattcaccgatgaaggtagcaacaaaatggttgattggttcgtcgtaaatgtccactggcgtcccagactgaacaatttcaccttcattcatgacaaaaatccagtcactcatggccagagcttcttcttggtcatgggtaacgaagacgaaggtaattcctagacgttgttgcaattcacgcagttcgtactgcatttctgttcttagtttcaagtccagggcagaaagtggttcatctagcaagacaacgcgaggctggttgataatcgcacgtgcaatagcaacccgctggcgttgaccaccagacaatttctgaatggaacgattttcataaccagaaagtcggaccatttgtaaggcttctgtcacacggcgttcaatttcagccttgtcaatctttcgtaatttaagaggaaaagccacattttcaaagacagtcatatgtgggaaaagggcataggactggaaaacagtatggacatcccgtttattggtcggaacatcattaatccgttgaccgtccagataaatatcacctgaactagcatccaataaaccagcaataatattcaaaatcgttgatttacctgaaccagaagctcctaaaagggtataaaatttcccctcttccaattcaaaactaatatcctttaatacagttgttccactgtcttcaaatacttttgaaacgttcttaaattcaataattggctttttcaattctcataaattccttcttttttgtaagagcctgatggctagagtgtatcagcaggatcgccgataatacgaacctctctctccagagtaattcctgaagatttttcaacaacttgaatcacatgggcaatcaaattttcgtaatcagatgctgtaccattttctatattgaccataaagccagcgtgtttttcagaaacttcgactccaccaattcgataaccttttaaacccgcatccataatcaactgtcctgcgaagtgaccaagtggacgcttgaagactgaaccacaagatggatattccaaaggttgcttgagctcgcgcaaatgtgtcaaacgagccatttcttgttgaataaccgtatgatttcctggcctgagggcaaattttgcagacaaaacaatcgcaccgttttcctgcaaaatagaagaacggtagccaaatcgtaactcacgattgtccaatgtctcgacataacctgcaggagtcaaaatctgcgctgaaactaaaatgtgtgccacttcacctccgtaagcacctgcattcatatagacagcaccaccaatgcttcccggaataccacaagcaaattcaaatcctgataacgaatggaaaagtgcgacttttgttgtttcaatcagattggcacctgcttctgcttcaatggtgtatcctgatacagtaacggagttaagtttatccatacggataacaaaaccacgaataccgccatcgcggacaatgatattacttgaatttcctaatacttgccatggaataccttcgcgtttagcaaattctactatacgaacaatctcgtaacgattccgcggaaaagctagataatcaacagctcctcctacttttgtataggtatattcttttaaaggttcatcgaatcgaatatcgatgccttctaattcaagcctaattttatctttcataaccttctcatttcaatttaagatatacaggatttattataccaaaaattacaggagaaaacgaataaaattcaacaaaaatactttcacaagccaaattaatttgccccaatattttgaaatggagaatggaatgcacaaaaaaaaggagttccctttctaccgcttacagtagcgatggcgaactccaataaataaacatgtttagttttgcaaatgacagattctcactatctatacaatagcaatccctttggtatctacttgaaggcggtggacagttccgtctagatttagttcctctaatgctagaacaatagcgtcctccctatctttgggcgctaataccatcactgttggaccggcacctgataagtaggttgcataggctcccaactcctgtgcagtttgcttgattggacaaaactccttaacaagtagctgacgaaacggttcatggaacatgtctgactgaattgctttcccagctttttccagatcacctgccatcaaactggcaacagcaacgtttgcaatggcactagcagccactgctttcttgtaccccatctgagaaggcagtacacctcggctttcaaccgtacgcagtgggtagtttggaataaaggcaacaaaacttgcttctgggaattctgttacaactgcctgtactctcttattaacatagctagagatgactaaattaccgaaaatcgctggggctacattatcaggatgtccttcaatttctgtagctttgagcaatttttcatccgctgtcatattcaaacctgctaattgattagccaattcgataccagctacgataacggaactggatgaacccaaaccacgtgccaagggaatatcactaatcattctgatacgatgcggctgcaatcctttttcaatctttaaagctgtcttgatcaaaagattgttcttgtctgatggaacatgttcaagattgtgctcaatcacccattcatcagtctcttcaaatacttcaatcgttagatatttcgaaagggcaacacctactgaatcaaatcctggaccgatattagctgaagttgctggaataataattttcattgcttattctcccagtactttaaaggtatttaagacagtaaagtctgtttctttactcaatttgtctgttacattttccaactgagtcttactcatttcatgggtcacaatcactaggcgggctgtttctccatctgcagcttgttgcagaatttgcttgaaggaaatttcttcagaattgaagatttctgctaaacgaagcatttttccatttttatcaggcgcatcaattgagaaataatattcgctcttcacatcgcttggggctgccaattgaagtgggcggctatattcgttaaaagctttgccgatagtattgtctttcaagcgacgaacgatacgaataatgtcagccataacacttgttgcagtcggtttttgcccagcacccggtccatagtacatagactggccgatgccgatagattcgacaaatacagcattcatcacaccattcacgcttgcaagtggatgatttttcggtaggaaggttggagatacttcggcagcaataccagaggtagtttcttgaatatcacccacaagtttgatgacatagcccaattcttgtgccactgctacatcttctggtgtgatattcgaaatacccttgtgtgctacgtgttcaaaatcaactgtcatcccgaaagcaaattgactgaggataacagccttgtaagctgcatcaatcccctcaacgtcatttgttgggtcagattctgcatagccaagttcctgtgctgtttgaagagctttttcgtaagtccagccttcatcaatcatcttagtcaacatgaagtttgaagtaccattcaatacaccgaggatacgagtcaccttgtcagcagccaatgagttaaccaaggtacgcaagattggaataccacctgcaactgcagcttcataataaagcgcaagacctttctcttcagccaaggcacgcaattcgctaccatgaacagcaagtaaatccttattggctgttacaatatgcttgcctgcttccaaggcatgtgtaataaatgtttttgctggctcaatacgtcccatcagctcaacgacgatggcaatgtcctcatcagctaaaatatcatcaatatttgttacaaaatgatagtcatgacctgcagccaagagacggtctttttctgcttcatccttgaccaaaaccttagcaacttcaatactatcatgcgcagctttctctattttttcctgattttcttctaataaaaatggcacaccactcgcaacggttccaaatcctaataatcctatcttaactaccatgtgctctcctttaaaatgtatttctcccattataacaaatattctgactatttggcaaaaaatttgatataattgttttaatatatgattatggagataagataatgaaacattcaagaagagcccgtcgaagccgcacacaaaagaaacaacttgtgccaatgctacttggcatcgcattattagtagtgactctactatctatttttctaatctttctaaaacagccatctaagcaacaaagtgattccaaagcttcaacggtagagacaacaaccacttcaagtgttataacttcagaaagtagtgaagtacaaacagaaatcatttgggaacaacaaactgaacctatcaaacttccaatcctcatgtatcatgccattcacgtaatggctcctgaggaagaagctaatgcgaatcttatcgtagatccaacgactttcgaaagtcatctaaaagcattgcaagatgcaggttactatactttatcacctgaagaggcttataaggtattgacagaaaatgtccttcctgctggcaaaaaggttgtctggctaacctttgacgatagcctctgggatttttatagttatgcctacccattgcttaagcaatatcaaatgaaagcaaccaacaatgtcattacaggatttactgaatatggacaagcagggcaccttactcttgatcaaatcaaggaaatgcagaccgcagggctctcctttcaagggcataccgtcaaccaccctgatttagagtatagttctatcgaggatcaaacaaatgaacttacttcctctaaagcctatcttgacagccaattaaatcaggaaaccatcgctatcgcctaccctggtggacgatactcagcagataccgtagccttaactgaacaagctggctacaaacttggtgtgactactaacaacggcttggcttctgctagtgacggattactgactctcaatcgtgtccgcatcctcccaaccactaccgctgagggactattatccgaaatttcctattaattttcacaaacatgtatatgagaaaactccctgtcactgacaagggagttcgttttttatttggattcactaaactggctttgataaagattataatagaaacctttgtctgccaaaagactttcatggttaccttgttcgataatctgtccatctttcaagaccaaaatcttatcagcttcctgaatggtagataagcgatgagcgatgacgaaacttgtccgccctttcatcaaccgtttcatggccttttgaatcaagagttccaaacgggtatcaactgaagaagtcgcttcgtcaagaatcagaatagcaggatccgccaacaaggcacgtgcaatggtcaaaagctgtttctgaccttgggaaatattgctggattcctggttcatttccatattataaccgccaggcagggtacggataaagtggtcaacgttggcagctttagcagcctccacaatttcctcatccgtcgcatccagacgtccaaaacgtaggttttccttgatggtcccttcatagagccaagcatcctgcaagaccataccaaattgactacggtaggattgacgtgaaagattttgaatatcctgcccatctaccttgatagcacctgatgtgacatcatagaaacgcatgagcaagttgataagggttgtcttacctgcccctgttggaccaacgatagcaaccatttcacctggcttaacatcaagattaaagttacggataagcggcttgtcttctgaatagccaaattcgacctgttcaaagctgacttgtccggtcaaaccagctgtcaactccagcgcattggcgtcttcttcatcaagctcatctaggactgaaaagatgcgttcaagggaagatttggcagactgtaactgtggtgccaactgggtcaaggtttggactggctgagaaatctgccagacgtattggacgaaggcctgcatattacccaccgtcaatgtacctgcaagaactttcaatccagatagcagggcgacgacaacataggcgatatttgagaagccgtgtaccaggggcatgagcaaaccagacatgaaactagccttgaaaccaacttcctgcaaatctgcggtaatctggcgaaactcttctgtagaaatttcttcacggccgtagagtttgagaacgttaaaaccagtcagattttcttggacaaagccgttcaaacgacctagggcatcagcctgctgcttgaaatatggctgggatttgcccatgacaaacttagaaccaaaataagtcactggaaccaaggttacgactacaagtgctagggatacatccaaccagaaacacatgaaaatggctagagagagggtcagaacggcattgactagctggagaaaactttgttgcagggcgtttgaaacagtctccacatcgcttgtaaaacgtccgagtaaatcaccatactggtgcttatcaaagtaagaaacaggaattttgttaattttgtgactcaaatcctgacgtagttccttagttgctccctgcactgccttggtcataaaatagttagaaccgtaggcaccgatttcatatagaagggcgcgaagggcatagatggcaagcatgatggcaatgtaggaatagttaatctgcgctccttctactccattagcaatatccaacagattcttggtcaattctgtaatgataagccccagtacaaagggctccaaggcattcataactgcactgatggtctttagaaaaacagctaaaaatacagaagatttgtaacgacgcaaatagtcccaaacacgggtaaatactgatctattcttcataattcctcctattcttctgttaacgattgacggttaagctgagaattggcgatttctcgataaatctcattgctttccatcaattcattgtgggtgccgcggccaacgatttcaccttcgttcagcacgataatctggtcagcatccataatggttccgacacgttgggccacaattagcaccgtcgcattttccgtcacttccttcaaacgactcctcaaaatcgcatccgtcttataatccaaggctgagaaagaatcatcaaaaatgtaaatatccggctgtttgacaatagcacgtgcaatggacaaacgttgcttttgcccgcctgacaggttgcttccaccttctgctagatgggtgtcgaatttttcttccttactctcgataaactccttagcctgagccacatccgtcgcatcatgaagttctgcaagactagcatccatcttaccgtactttaagttttccgcgatagttccggtaaatagcagagctttctgcggaataaagccaatcttgctgcggagtgcctttagattgtagcgtctgacatccacaccgtccaccaagatacgaccaagtgtcacatcatagaaacgtggaatcaagttgaccaaggaagacttaccagaacctgttgaaccaataaaggcaatcgtttcaccaggcttagctttgaaggaaatattgtgcagcacaggcgattccgtttcaccagggtaggcaaaagttacattttcaaattccaaataaccacgagtatctgtttcagttatgccgtcttcattcttagaaatggaaatgggcatgtccaagacttcctgaatccgttggctcgataccgacatacgtggatacatgttaaacaagttagcaaagagcaagaaagagaaaagcgcgtggaaactatattcgataaaggctaccaaatcaccgatttgcagactgcctgttttcaagggatccaaagcaaaccagacaatggccacaatcatagcaatgataatctggacaaagagaggctctgtcaatccagtcagattaaagagctttttggaaatatcggtatattcctcattgaccgactcaaagcgctcctcttgaaactcctcacgagtaaaggcacgaatgacacgtaagcccatgagattttcacgaacatattggttgatcgtatccaaacgtttttgttgtttttcagagagaggacgagtttttgttgccacatagaaaataacaaaaactagaaacggcatggctactgctactgtccaggctaagctcggactggttaccaaggtcatgatgacagaagcaatcatcatcaagggggtaataatacctagttttaagaccatttcagagaattgcatgagaacaaaagcatcatttgtcatacgagcaactagagaagaaacaccaatctgctcatattcatgatgagaatagtcctgaattttctcatacagatcatttcgaatatccttgacgatatttgtagttaactttccagctgcataggcaagtgtcactcgaccaacaatcccgagcaggacaatcaatcccatcatccccgcccagaaatagagctgactaacatcgttctttgtaattccttggtcaatcatcctagccaaaaaagtcggcaagcctaagtttaccactacaaataagaaggcccccaacaagtctaaggcaatccacttaggatattttttcaaataggtccaaatcagattcatcatttcttcctttctatatgttaaaaaggggctaggcccctttgtcaacgttaaaagccaccaaacggtgactttctattctttctcgtcgataactaaacgaacttttttatcacttgttggaacagaatagacaatcgttctgattgcagaaattgtgcgtccttttctaccaatgatacgtccaatatcagattgatccaaatccaaatgatattccaagaattcaggtgtatcaacaatttttattgtcaagctatcaggctgtgaaatcaaaggtttcacaatcgcaataatgagattttcaatcatgtccataagtgttctcgcttactgttcttacttagagaatttttgttcgtggaatttcttcaatacgccagcgtttgaaagaaggctacgaactgtatcagatggttgtgcaccttttgccaaccactcaagtacacgctcttctttaagagttactgagttttcagccaaaagtgggttgtaagtaccaacagtttcgatgaaacgaccatcacgtggtgcacgtgagtctgcaacgttgatacggtagaaaggtttctttttagaacccatacgagtcaaacggatttttactgccatttttaaatgttctcttttctttgtatttttattcggtgaaatagcagagctatttagcacatgttctattataccacactttaacagggtgtcaagaaaaaaacttgacaggttttaaaaaatttattgttcgagcatatctgctagttctctcagttgacttgctagatttgtacggtcaaacagtaaattatagactccatcttcactcaatactccgcaaggaataccattgaaataacccttattagataaatcaagatcttccatataggtctggctctggtaataatctaataactgtaaataagtcgattgttcctggttgagttgtgccatactatcggaaagggactggttcagctctagctgtctgttaaatattttttccatttcctctacacgttttcttgcttccataatatttttcatcagtgtgtactgccaccaccctttttaatatcctctttatccctatattcaacaatcgctcctatagctacttcaactcctcttacaatatcgttcaaagacatggaagccagtcctggtttgtcgacaacctgctctggcaagaagggaatatggagaaagcctgccttagtctttggaaattgtttctccgccaagtaaagagcttgatacatgagatggttgcagacaaaggtcccagcagtattagaaacagaagctggaagcccaatcctatgaatagcttcaaccattgctttgatgggtaaggtggagaaataagcaggctgaccatcttctcgaatcgttctatcaatcggctgttgcccctcattgtctggaatgcgtgcatcatcttggttaatggctatacgctcaggagttaaatcaactcgcccaccagcctgaccaatacatagtaccgcatcaggtaaatgttctgccattttctcctctaaaacatccgcagccttgtcaaaaacagtcggaatctctacaagaataatctctgcaccagcaatggtcttaggtagagatttgattgtttccaaggctgggttaataggctcgccgccaaagggatcaaagcctgttacgatgattttcatacttcctcctccaaaataatttctccgtagtgaaatttttgattgggtctgacatgacgtttaaagccaaattcttcaaagacctgatctcgaaaatgagcctttattatcaatttcttcctagctactcgtttagcctcagatacaatttcctccgttaaacggcttctgtcagccaaagtagacaagccagaaagattttgtgattccttgatttcttctgaaaacatgggatcaaagtaaatgacatcaacagacttatctatttgccctttcaaataagtcaaactatctgtccaaattgtctgaatagatttcatggctcgattgacctcttgcagcccactatcaaaatcctgtaaacctcgactcacaataaagtgcactagcttagaactttccaaggctgtcacccgatgaccggcacttgctaacacaatgctatcagatcccaagcccatagtacagtctattattgattgtttttcttttccaagtaattctaaaagcggatctcttccagacttaatccgcaacatggcagtatctgggtggaaaaataaaacctgcccacccctctgctctagtatcaatttatccttataaagaaccaagacagcctcgtaggtacctaacatttttccaaccgactgcttctttctttccttgtattcaattcccagttcactggcaatccgtctagccctatagaccagcccctcatccatcccaagactagttgttacaatcattttcatactcttcagtatatcaaaaaatcaggacgaattcaaagctcatcctgatagtatcttctatatagcctgtgtcatgaagctacgactctccagcactttgaccatagcttctgctgtatcgagggccgtaaagagcggaattcctccttcaatagcagagcttcgaatgacttgaccgtcaccatctgccacccgttttttaccaaccgtattgataatagcctgaaccttacctgcccgaacaagactaggaatatctggacaggaatcatcgcctaatttaccaacagttgttacagcaagtccattttctgttagaaaggtggctgttcctgccgtggccagtaggccataaccaagttcatagaaacgttgagccagaccaagcacttcttccttgtcttcatccgcaatggtaaagacaacgttgccaaactcagccaggtgctgataacttgcctcgaaagccttataaagcgctttttccagtgtcaagtctgaccccataatctcaccggttgacttcatctctggtcctaacaaactgtcaactttagctagtttcgtgaacgagaagaccggtgccttgacgtgcacttggttgctctcaggataaagaccgtcttggtagccaagttccgcaaggctttgtcccaaaatcaatttggttgcaacctgagccattggaatgtctgtgactttggacaagaatggaaccgtacgactggcacgaggattgacctcaatcacatagaccgtttcatccttgatgataaactggatattcatcataccgatacagttgagaccgattgccaagcgtttggtgtagtctgcaatggtcgcctgcacttctttggacaaggtttgtggcggataaacggccatcgagtcacctgagtgaaccccagcgcgctcgatatgctccataatacccggaatcaagacatccttaccatctgaaatagcatccacttcacactcacgaccgacgatgtaagaatccaccaaaactgggtgctctggcgaagccttgaccgcagttctcatataagaacgtaagtcctcttcattttcgacaatctccatagcacgaccgcccaaaacatatgatggacgaacaagtaccgggaaaccaattttgcgggccgcttcaagagcttcctcttcgttggttgcggtttggcctggtggctgtggaatccctaggtctttcagggctttttcaaataaatccctgtcttcagctctatccaaatccgccacctgtgtccccaagattggaatgcctgctttggccaatggctctgccaaattgatagccgtctggccaccgaactgaacgataaccccttttggtttctcaaggtcgatcacattcaaaacatcttccaaggtcaacggctcgaaataaagcttgtccgaaaccgaaaactcagttgacacagtttcagggtttgagttcataataatggcctcgtagccagctgcctgaatggccttgacagaatgtaccgtcgcatagtcaaactccacaccctgtccgatacgaattggaccagaacccagcaccaaaacagattctttctccgaacggatggactcattttcccactcataagttgaatagaaataaggtgtagcactttcaaactcagccgcacaagtatctaccatcttgtaaacggggacaatcttgtgttctgtccgcagttgacgaatgtaggattctgtccgtccccagagttccgcaatcttgcggtctgcaaaaccgtatttcttggcttttttcaataaatcaatattatcaaaattcgttgccaattcctgctcgatttctaagatatgaagcagcttatcaaggaagaaaagatcaatcttcgtcaattgagccagttcttctacggtatagccacgtcgaagggcttctgaaagatagaagagtcgatcatcctgtgccttgacaatcttttcaaccaattggtcatctgtcacttggctgagttctggcatttcattgtggtaaacaccgatttctaaagaacggcaggccttgagcagactttcttcgatattacgcccaatggccatgacctccccagttgccttcatctgcgttccaaggcggcgttcccctttttcaaacttatcaaatgggaaacgtggaatttttgccacaacgtagtcaagagctggttcaaacatggcataggttgttcctgtaacagggttcaccatttcatccaaggtcaagccaaccgcaatttttgctgccaatttggcaataggataacctgtcgctttggatgccaaggcagacgaacgggacacacgtgggtttacttcaatgacataatatttgaaactatgtggatccaatgccaactgcacattacagccaccttcgattttgagggcgcgaataatgctgagactggcatcacgcaacatctggttttcaatatccgaaagcgtctgcgttggggcaaatacgatagaatctcctgtatgaattcccacagggtcaaagttttccatgttacatacgaccaaggcattgtcagccgcatcccgcatcacttcgtattcaatttctttgaaaccagcaatggaacgctcaatcaaacactgagtcactggtgacaattttagaccattttctgctatttcacgtagttcttcttcattggcacacataccaccgccagtaccacccagcgtgaaggctggtcgaacaatgacaggataaccaatttcagcagcaaattccaaagcctcatcaactgttgtcacaatcgttgactcaggaataggctgattgagatcttccatgagttgtttgaagaggtcgcggtcctctgcctgatcaattgcagacagtttagttcccaacaactcaactccaagctcatctaaaataccagccttagacaattccatggccatgttgagaccagtctgaccaccaagagttggcaagaaagcatctggacgctccttccgtaaaatccgtgtgacaaattcaagcgtaattggctcaatataaaccttgtctgctatttccttgtctgtcataatggtcgcagggtttgaattgaccaagaccacactgtaaccttcttccttcaaggctaaacaagcctgagtcccagcataatcaaactccgcagcctgaccaatcacaatcggaccagacccaatcaccattattttcttaatatccgtacgttttggcataatgtatgatacaaagcccgttaagaggacaaagcgaaaataggaaacacgacgctgatgcttcaagcatcaagacgacgtttatctttttcgcacagtccttagggcgtgttcgaatatgaaaatcaaatcttattcgaacctgtaccttctcctttctattcgtcgcctctctgagcgacattaaataagataagtccgacgtttagaatctcaattcgataataattgaaattctaaactagtgtcagagttagcaaaggtcccattggactttgcgtaggaggacacatgcgttagcatgaagtccgacttgctctgaccgacgcagtaaggtttagctcgatagtagttaagccttactgcccttttttaaacgaatccatcaattccataaattcgtcaaacaaatagctggcatcatgtggaccaggtgcagcatctgggtggaattgaacagagaaacctggatagtacttgtggcgtaccccttctactgatttgtcattgatttcttcatgagtaatcattaaacattcaggtaaatcttcacgagccactgcataaccgtggttctgactggtaaagtccactcgacctgtcgcaatttcacgaacagcatggttgaaaccacggtgaccaaacttcattttataagtcgttgccccatttgctttagcaaagagttggtgccccatacagataccaaaaattggaatttttccgagaatgccccgaatcatgtccaaagcttctggaacatcatctgggttaccaggaccgtttgaaagcatgacaccgtctggattgagggcaagaatttcttcagcagtcgtatcataagggacaactgtcacattgcaatcacgcttggctaactctctaagaatagaatgtttcaatccaaaatcaaccaaaacaacactacgtccaactccaggtgcaggataggctgtttttgtcgatacttgctggatgttgttggttggcaaaacagtcgctctcaactggtctgtcaaatgctcaacggaatcaccaacatttgccaatgtcgccttcatggtcccgtgctgacgaataattttagttagggcgcgtgtgtcaattccagaaattgctggaattttcttagcctttaaaaattcatccaaagtcatctggttacgccaattacttgctcgacgagcccactcgctaacaaccactcccttacaagtcggtttgatcgactcgaaatcatcacggttaatcccgtaatttcctaccaagggataggtaaaggttaaaatctgaccattataagactggtccgtgatggattcctgataacctgtcatcccagttgagaaaaccaactcaccagtcacatcaatatcagcaccgaaggcctccccctcaaaaatagtgccattttccaaaattaaacgtctttttgacataatctatgatacaaagcccgttaaaaggacaaagtgaaaataggaaattcggcgccgacgctataggcgtcaagtcgatatttatctttttcacacagtccttagggcgtgttcgaatataaaaatcaaatcttactcgaacctgtaccttctcctttctattcgtcgcctctctgggcgacattaaataagataagtctaacaaatttctaactgctcagttctaagatacctgaacagcttacttttaagccttgccattgacaattgcttccaaaatcgccatccggacaaatacaccattctgcatttgacggacaatacgtgatttgggtgcttcaactagagaatcatcaatctcaacatcgcggttaacaggggcaggatgcataacaattgcagtatctttcaagcgtttgtagcgctcctctgttaaaccatgcaaacggttataagtttctttagaaaaaccaccatcaccatcatgacgctcgtgttgcacacggagcaacatcagtacatctaccgtttccacaatatcatcaatattcaaatgctgaccatagacgtcaaattcctctgcgtaccattcctccggtccagcaaagaaaatctcagctcccagacgcttcaaaatttgcatattggacttagcaacccgtgagtgtgtaatatcacctgcaatggcaatcttcaagccgtcaaaagttccaaattcttcataaatagtcatcaaatcaagtagggattggcttgggtgttgacctgaaccatcaccaccattgacaattgaagtctgaatggtaggactatcaatcaattgcttgtaataatccacttccgagtgacgaatcacgcagatgtctaccccaagtgccgacatggtcaaaatggtatcacacaaggtttcacccttattgactgagctggtacgagcatcaaagtcaatcattcccatatccaaacgaagctctgccatttcaaaagacttatgcgtccgagttgaatcctcaaagaaaaggttagaagcatagtacttccgatctaactctaccttttcaccgcgtttaaaagcaataccacgttgaatgagtcccaatacttcttcatttgagagggtctccattgtaaccaagtgtttgagtgaaactttaccatttgtaattgtcatgatgatacctacctttatgatctagatgtagaatgagaatttgtaaacgaagcgactatgcaccttcaaccagaagaacagcgtcttgaccatcgatttcagccatgtgcacaatgatttcttcagaacggctagttgggatattcttcccaacataatctgctcgaataggcaactccctgtgtccacgatccacaagtaccgctaaactaacacgagctggacggcccaaggacactatgttgtcaatagcagcacgaatagttcgtcctgtataaagcacatcatctactaatataacatcacgatcgttgacattggcagtcatatttgtcgtatcatcttctaccttcatgtcatctcgaaacggtttggtatccaactcacccaacggaacgtcgataccctctaattgcttaagtctctcctgaatcctctttgcaatgaaaacaccccgtgttttaatccctgcaaggacaatattatccaaattcttattccgttcgataatttcataagtgatgcgggtgattgcccgtttcatagtcatatcgtcaacgatttcttttgtcttcataagacctccaaaagtatagaaaaagtctccttatacaaggagactatgaaaatataggctagttagaaccaacctgcttaacatccgactccttgtctgcctctctggacaggttttaaaggatttattaagcagagtatagcataaaatctcagccttgacaatttttttctgaaaaaatatagaaattatcggattttactgagaattttttccaaaagacaatgaagtcttaaggtttatggattttagtcccgccaatagaaaaccgcagactagataggcgacaaagatgactccagcataagtcaaaacataggtccaaccatacttagggacattgagaaagaaataagcaaaaggactgtccttagcatctgggattggaatttttatgaaaagaccattcactagaccaaaaatcatgtaaagaacaggcaaaagcgtccaccaaatcgggtcaaaccacttgtactgttgctgacgatctactattagggtatctaacaaaaaatataagggaacaatataatggcagagtagattttcaagtcgccagaaatcgtctgccaaaggtgccaacataaagtgatagactacacaggtaatcatgatagacatggttacagcagcctttatccgaagaaaacgtgacgtctgtaaatccacacccttactcatggcatagaccatatagacagcgaacagagatactaataaattagattgtaccgtataatacatgagcatcccgatacaatatttaatgatttctaaggcggtacctgtgatggctaaaatagctaacaggcatctactgtaaaacaaaatactttgatgtttcataatatcctttcaaaaacaggaaaagactggttaaccagtcctctctcttagattttcttaacaaattcagatttcaacttcatggcaccgaaaccatcgattttacaatcaatattgtgatcaccttcaacgatacggatgcctttaacacgtgtaccttgtttaaggtccttaggcgcccctttcactttcaaatctttgataagcgtcacagtatcgccgtccgccaaacgattaccgttagcatcaattgcaacaggtccactttcttcctcagctacatctgctgggttccattcgtatgcacactcagggcaaaccaagagggcaccgtcttcatagacatattcagaattacattttggacaatttggtaaagtttccattcttactctccttaacatttttcatgttctagtatagcatttgttgaaaaaatgggcaagatgataaggttttcatactattattcagccttgcgcagtttttcaagtgcctcctgaaaaatagctggcgcttctgccgtaaattcaacaacctcaccagttctcggatgggtaaatccaagcgttctggcatgaagaaattggccatgcccttttagtgttttccttgggccgtaagcttcatcacccgcaaccggatgaccaatataagccatgtggacgcgaatttggtgagttcgtcctgtttccaaggtcaattccaccaaagtgtagtcaccaaaacgctccagaacctgaaaacgtgtcaccgcttctttccctttggcagtcaccgcttgtttcttgcggtctttttcagaacgaccaatcggcgcctcaattactccgcgatcgtttggtagattgccgtgtacaatggcccaatacttacgaagggatttcttatctttcaattcagcagcaagctttgtatgggcatcatcgtttttagcaatcatgagcaagccagatgtatccttgtcaatccgatggacaatacctggtcgcaagacaccattgatgcctgacaaatcttttacgtgataaaggagagcattaactaacgttccagacgtgtgaccagccgacggatgaacgaccatcccttgaggtttatttacaacagcaacatcctcgtcctgaaagacaatctctaaaggaatatcctcagcaacatagtcgatttcttctacttctggaatttgataggttagaacatccccaacctgcacactatatttagcttttttaggctgtccattgaccaaaacctgaccagccttaatctgctcatttgcaaccgaacgagacaaatccgtcaaatctgacaatgccttatccaaacgaataccaccaacctcaactcttacttccattactctcttctttcataatacaaataaataaaatacctacaccaactgtcagacaaacatctgctacattaaatacagggaaactaataaaatccaagtgaaacatgtccaccacatatcccaatctaagacgatcaataaaatttccaagagcaccagcaatcatcaaagacagactgaataaagtccagatattgcccttaatctgtttgatatagtaccacactaggcctgtcacagcaacaattgtcattatcgtgaaaaaccactgctgattttgtaaaatcgaccaggcagcaccataatttcttagataagctaagctcatcaatcctggtataaattccgttaccgtatctaattcaatattggcaactgtccaagcttttacaaactggtccaaaccaattaatactaccatcaaaaatggaaatccaattttacgcattttcatccttcttcttatcaaaatatgcctgcatggtttcaataaagtctttggcacaagaactaagttcatcattagctcgtttaacgtagaccatgcgattgtctacctttcctttgagaggaattacggtaatgccattgacactctcgtcatcaagatagcccgaaccagttgcataggcatccgtacgctccaaaattccattcaaagtagcacggtctgtcacatcaaacaccaccgaggaatccgacgtatcaatcaagttctcggaataataaagataagcctctttttcttgagtgaaccgtacggtaggtagacctaccaaatctactggatcaatctcagctttctttgtcaaaggatgatcttcacgaaggtagatatgagtctgaaatgcagacaaatctacagcttgcaagtgaagtttatccaatttctgcatgattccttttgtatttctctcgttcaaataaataataccaagctcgctataaccttgagcaacctcatctaaaatctgtactgtagtagattcaaaaatgcgaaaatgagggtactgcgggtggctacgagagaactccgtaatcaatgggggaagaaaatcataatgctgacttgaaattgaaaaagtcttctcaccttcctcaggttgcaaatagagatgctcaaactgatcaaatcccttaactaaagcctgagctttctcatagaattccatccctttttgtgtcaaaaaagttcctgaactagttcggctaaaaatttgaaaacctaactctttttccaaatcacgaatggaaatggacaaactaggctgggacacatacattttctcagccgcctctcgaaatgtaccactgtttgcaatggctacaacgtagcgtaattgttgaatattcatacctgatacctcttaaaactgcttctaccattatatcaaaaaaagcaagaatttgctgaactcttgcgttttcgcaaatagactagcccgtcctgttcttcaaaactaatttcttgtataacttccaggttcccaatttctcttcttcaactgcaatttgaaaggctttggaatttctgttcgccaaatcatcaatgactaattttactaagttggaacccataccacttcctctgaacatttcatctactactgaacgtagaacttataggcagcgcaacagtgcagatggcaaaatatttttatcctatagagaagatattgccgtcttaaatcacttctatcgtacacttttaaaaatagcaaaatcaaattacaaaaaagactctccgaaaacaactcggaaagcctattgtaaagccattttcagacttattttgcgattggataaacagatacttgtttcttatcgcgacctttacgttcgaagcgtacaacgccttctactttagcgtaaagagtgtcatctccaccacgacctacgttagctcctggatagatttttgtaccacgttggcggtaaaggattgaaccacctgatacagtttggccgtcagcagctttcgcaccaaggcgtttcgcttgtgagtcacgaccgtttgacgttgaacctccaccttttttgtgggccataaattgcaagttagcaagattcaagtttaacatatgttattcctccgaatttctgtaatgattgcttcaagctacgcgattaagcgttgatagcgttgataacaacttttgtgtaaggttgacggtgaccttgtttgcggtggctaccttttttaggtttgtacttgaaggtaacaacttttttctgtttaccttgtttttcaacagtaccaacaacagtagcgcctgctacgagtggagtacccacaacagttttctcaccaccaacaagaactacttcttcgaaagtaacttcttgacctgcttcaacgttcaatttttcaacgtagatagcttgaccgacttcaactttaacttgtttgccgccagttttaatgattgcatatgtgctcattatgcacctcctatgatttttgggtcttacccgaatttgatgtgaagactcgcctagtaccgtgggacgaaccacttactctactctcaacgaaagaacggcattcgtgcggttgcacaggatgtgtgcatagtcaacagtcctattataacaaaaacacctgcaaatgcaagtgttttgtatcatttttttacatttcaaaaacttcgctctcctgcttgtttggtaagaatagagagaggacgattccgacaagagctggtaataaccatgctaatgattgtcctgccaatggcagagctgagatgatttttgaaacagcagtccagttgaattgtcctgctaacacttctaccaatgacaaagctgtcacaagtcccacagttaattgcataccataagtcgaaagcggtacaaatttgttaacaatggtaatcaagacaatacagatagtgattggatagagaaccaaaagaactggaacagagaaggtgatgatattgttcaaaccgaggttggcaatcccaaagccaatcaaggtaaagatagtcgcatatactttgtagctaaaacgtgggaaacgctcagcgaaaaattcacctgaagaaacaatcaagccagccgtcgtcgtaaagcaagtaacgataaccatagcagctaagaaaatttgtgcacctggtccaaaaatagcctgtgttgcttgcgaaagaatgtaaacacccttgttggtatcggaagccaaaacatccgcaggcacaggaaaatgatttcctaaaaaagccaaaccaacatatagagctgagaatgccaaggctacaactaagccaacagaccaaatagttgatacatattcccttttgcttgagaaaccaagttgtttcaaggtatttactgctacgacactaaaagcaatagaagcaagtgcgtcgagtgtattgtatccctcgataaatcctgtaccaaatgcctgtcctgctgagtaagcttccgaagctggtaacggacttgttgatccgtacttaacaataccaagcaccaccaaaatcacaatcaaaatcgcaaaaacaggggttaaaatacgtccgatactatttaagatttgagatggattgagggcaatcagataagctgccacaaagtatagagctgtaaagccaaacaaccaaagaccgagattcgcatcgcccaataatggcgcaataccaatttcaaaggacgttgtagctgtacgcggaatggcaaagaaaggaccaatcgccaaatacaaggcaacaagataaatcgttgcaaaagtcggtgaaatcttgcgagaaatctcatgtacataacctttggggttcaatgttccgacaatcagggcaatgactgcaataccgacacccgaaacgacaaatcctaaaatagcaggccagaaattctcaccagataagacaccaagtgcaggtgggaaaatcaagtttcctgcaccaaaaaacataccaaacaggagtaatcctgttagtgctccttttttcataataactcctttgtttttttctgaagtcttattatatcatacaaattcgatttttccgaacgattcgtattaaaaaatccagcaatagctggatttaaatgtatgccaaaacaattgaattctacagtaagtcttcaattaaactatccacttcgtctttcacttcttctttcggtgtgatttcagttacgataatcccagccacagctcgttccaccaagccttctacatccattcgagcctcgtattgctcgacatttttgattttagggttagtttttggacggtcaggggcaaagatggtacagcaatcctcaaatggctggatggaaatatcaaaggtatcaatttcttgtgcaatatcaatgatttccaacttgtccatggtaacgactggacggataacaggtgtatttgtcaccgcattgatagcctgcatggattccagggtctgacttgccacttgtcctagactttcaccattgataataaccatggcaccacgctcttcccgtactcggtctgtaatccgcatcatgaagcgacgtgtcaaggtcatcaaataagcttcaggtgccttttccttgatttcttcctgaatttctgtaaacggcacttcaataaaggtgatattaccaccaaaggcagtcaatttgcgagtcaaatcatgggcttttttaagcgcacccgggctagtataaggcggacttgcaaagtgcagggcttcgatttcaaccccacgtttcagtgctaaatagcccgcaacaggcgaatcaataccacctgataacataagcgttccttttccagatgttccaactggcagaccgcctgcccccttgatttcttcatgagaaatataagcagcatcaggacggatttccactcgcaaggtaatatctggtgacttcatctgtacctgtacatttggaatagctgtaaaaaccgcatctccaaggacttggttaaggtcacagctgtccaattcaaaactgtgatcactacgacgcgcagcaatcttgaaggtcatcccttccttgtaaatggtctgcattatttccacaaccgcttctttcaaagctggaacagacttttcaatcttataagacggtgcgaaattttggatcccaaaaatcttcttcaaagaagctgaaacttcctgataatccgccccattcaaatagacatgaccacggtcacggtcaaaataaacggtcacttctgggtaaacagaaaggacatgcttgatattattgcggagtttgttgacaaaccgcatcttgtttttccctttagttgacaattcgccatagcgaatcataatttctgaatagttcattctaccttactttctgtgtgttttgataaatttgtttgaaaatcgtgaggaattgttcgatttgccccatatcgttgtcatcatccaagctgatacggacggcagtttgagccaacttctgcggaacccccatagcaattagggttccagccggttttccagccttggacgagcaggctgaggttgtcgaaatgtaaatctggtggtcttcaaaggcatggacaatgacctcgccacggatgtttttaattccgaaagttacaatactgggcacaaagtcctctagcccagaaaaaactgtcacatcgtcgtatttgcccaattcatccacaaggatctgcttcatggctgccagtcgcttttggctatctgctgccttgtccaaggtcaagcggagcgccttagctgtcgcagcaatgccagccacattttccgtggttgagcgtttatcgctttcctgtcctccccctgtcaatagcggagcgattttcttgccagctttgatatagacgaaacctactcctctgacagagtggaatttgtgacctgaaaaactggcaaaatcaactcggtctgtcaaataccgttccgtcggcactttgccgatagcctgcaccgcatccacatggaatgagatggttggcttatcagctaacagttgagatatttcctgaatgggctgaatagcaccaatttcattgttgacggccatgatagaaaccagtgtggtatctggacgaatcaagctttctaaggctgaaacatcaacaaaaccttgggcattgaccggagccaaatcaacctcaaaaccttgcgttttgagccaaagcgcagattcttttacggctgggtgttcgatagccgaaacgatgatgtgcttgcccaggtgtgccttttcaaatgccactcccttgatgacccagttgtcaccttccgtaccacctgaggtgaaaaagatttctttgctatcctggccaagcaattctgcgatttgcttgcgagatgcttccaaaatacgggttgcctgactgcctagactatggaggctagaggggtttccccagatttttgtcgccacttccgtataggtcttgagaacttctggatagacctgtgtcgttgccgcattatcaaaataaatcattttttatattccttttattgcaatagtcctattttatcatgttttcatgcctttcggcaatctttaagatagttttaaacttcctatcttaaactaaaggtggaggtacatcatgaatacacgtaagaatacaaataaaaaaccggctggtttaactaattttcaaaaatatttaacctttatcgggtctattttagggattatcactgcctgcatcactatctacacctttacagcaaaacctgcaacatcctcaacatctccaagtactaccatttcatcatccagcgccactagccccagccaatcatcaagcgacaatccattaacagaagtacaagattcaacaagttcaagctccgaaacaacatcctcaacccaaaccgagaccagctctttagtagagtcgactgtctcttcctcgtctacagaaacgtctgctacccaagctttggagacaaggacagaaaccagtactgatacagaggtaactagtggggcatccgaaacgacttctaatcaatagcacaaaaatatttgttttacattcttggatttgatatactaatttcaagaggtgtgcaatatgaaatacgtcattctaaaaacgccgattttcgtttggctactgatttttgcgcttatacaaatcttcgccttatcgtcatttttaccagaaccatttgatactcgttcattgctccccatgggagtattgaccggttgttcaatcagggtttccagtgaagttaaagaccaggatggtcagtatgctccatttaagtacttatggtgggtgatactaggatggactgtaatcggtattctatttggtatcactataaaagcaccactagaattgcacattgccctgattgtacatgcaatcgcagggggaataggctaccgccttattgaacgttatgcagtttatcgctatcattatttacaaactaaaaagaaaggctaaccctttcttttttattaattataatctattccttaacgcatcaatatccgcttgactagttgaccagctggtcgcaaagcggatgatactgtggctatcgtcgtatttctcccagaagccataggcaattccaacttctgtcaatctagtcaattcttcattcttaacaataacaaattgctgattggtcggggatttgagatagaattgaaagcctttctcttccaaaatctgggtcagttgctctgccattgctatagcatgacgccccaattcaagatacaagtcatcagtaaataagcaatcaaactggatacctgtcactcttcctttcgccaacaaggcactatggtgtttgacaatcgatacgaaattcttaggctggttgttctttgtaaataccaaagcttcccccatcaaggcaccgagttttgtcccaccaatgtagaaaacatctgtcagctctgcaattgtcttcaaatcaagatccgtatcgcgtgcagcaagaccataacccaaacgagctccatctaaaaaaagcgggatgttatgatgacgacaaactgttgacaaggcttctaactctgacttgctataaagtgtaccatactctgttggatgggaaatataaaccattcctggatgaaccatgtgagcatgattagcatctgcgtagaaatcggaaatatagttctcaacttcacttgcgacaagtttgccatccgtatgcggtaaggccaacaccttatggcctgtaaattcaattgcccctgcttcatgaactgcaatatgaccagtatccgctgcaatgactccttcataggaagctaacatagacgaaatgacaatttgattggtctgcgtgccacctgctaaaaacgtaacttgtgcatgaggacagtccgtagcaagtctgattttttcgatagcagattcagtatatttatcagtgccatatccagataaaccttcttggttgcttgcaactaaggcttctagcaaggcgggatgggcacctttgttatagtcattttcaaaatgtaacatatcatagcctccttgatataatataacaaaaaagcctgttaatgcaggcttttcaatttagtccaccctgagggaatcgaacccccatctcaagaaccggaatcttacgtgatatccattacactaagggtggaaaggaaaaacttgcacaaggcaagtttttatatgaattacaattcaatgtcaccgaaaagatcagccattgagaaaccagattgagtttctggcaattcgtaatcacgtttttcttcacgtttttgacgacgtggacgtggagcacgtttttcagctttttcttcaccttcaactgctgctggacgctcttccaaagctttgatagaaagtgatacacgctcatcagctgcgttcacttcaagaactttaacagttacttcttgacctactgacaaagcgtcttttggattttcaacacgtttgtgtgaaatttgtgaaatgtgtaccaaaccatcgatacctggcaatacttcaacgaaagcaccgaagtcagtcaagcgttttactttaccttcgattacatcaccagctaccaatttttgctcaacgccatcccatggaccaggctgtgtagctttcaatgacaatgatacgcgaccttcaacttcatcgattgcaagaactttaacttcaacttcttcaccaactgttacagctgatttaggagatacgttacgctcgtgagacaattcagtcaagtgtaccaaaccatctacaccaccaaggtcgatgaatgcaccgaagcttgtgatacgtgcaactttaccagtcacaacttcaccaactgccaatttaccgaatacttcagcacgtgcagctgcagctgcagcttcaacaacgtcacgacgtgacaagatgaaacggttctcagcaggatcaacttctttgattttagcatcaaattcttgacctacaaaacgctcagtgttacgagtgaaacggctgtcgatcattgaagctgggatgaaaccacgaagaccttcaaattcaactgcaagaccacctttaacggcacgagttactttaactgtaacaacttcttcttcacgaccaacaagcttgtcccatgctttacgtgcttccaaacgttttttagatacaagataagtaacagtgtctgtatctttaccaacaacttggcgaagtactaacaattcaagtgtttcaccaacttttacaaggtcgttgatatcagcatcatggtcgttagtcaactcacgaagagtcaatacgccttcaacaccagtacctgagatagctacgtttgcttgaccagcatcaactgtcaatacttctgcagttaccacatcaccaggtgtaacttcgcttacactgttcaacaaatcttcaaattcgttcattataaaaaaacctccgacaatcaggtctttcgacccaacataaaatatattttatttaaggcacacgcaaggacaacaacaattagacatctttgacgaactagactatatctagtacctttactggggtagctggattcgaaccaacgcatgagggagtcaaagtcccttgccttaccgcttggcgataccccaaaaaatagatacaattcatttatttactaatcataagaaattgaactcgagattaatttcttagaaaaatagatagccttccttgagtgttaacactcagcgtcagtctcctaattttctacagaaatttctggtaaaccagaacatatctcgtatcttagttgaacacggactaaaatcctagtgaaaaagataaacttccctgtgtgtttagcacactgcgtcaatttcctattttcgtacggatttcttaacgtcctttgtatcctgttcaatggagagagagggattcgaacccccgaacccgaaggagcggatttacagtccgccgcgtttagcctcttcgctatctctccgtacactaacagtcactattctaacataaaatagcgactattacaagtcttttagtgacttaaattataattttcaataatatttccgactgctttttctaattttttgtaaaagctttcggtatttccgtttttaataactgcaaagttattttcagccaattctgcaatttctccaattacttttttacctataacaaggcggtagccagggaactcttctctattgacaagaactttgctatcttcaatctgaatttcaatttttttatcttttttactcattttcaaacctcacttttactattctacaaaaaaagagaagagcttgcaagtgcaagccttctgaaattaatctacttcgacaatccaaccttctggcgcttcaatatcaccaaactggatacctgttaattcttcatacaatttacgagtgacaggtcctacttctgtttcactatggaaaacatggagtttgtctgcaatctggataccaccaattggtgagataactgcagctgttccgcaagctcctgcttcgacaaactggtctaattcttcgacaaggacttcacgctccacagccttcatacccagacgatgctctgccaagtacaagagagaatacttggtaatagacggcaagattgatggtgaaatcggtgtgacaaactcgttatcagctgtgataccaaagaaattagcagaccccacttcttcaatcttggtgtgggtagctggatccaggtagatgacatctgagaagccctgctttttggcatattggcccggtaagagcgacgccgcgtagttaccaccaaccttggctgcccctgttccatttggtgccgcacggtcgtacttgtcttggatgaggaagttggtcggagccaggccgcctttgaaatagttaccaaccggcatggcaaaaactgtgaaaatgtactcttccgcaggtttgacgccgatgatgtcgccgacaccaatcaggagcggacggagataaagggtcccaccagttccatagggaggaacgtagtctgcattggctttgaccacttctttacaagccttgatgaaaagatccgtcggtacaggctccatgagcaagcggtcagctgtccgttgcaggcgctcagcgttttggtctggacgaaagagctggagttttccatccttggtacgataggctttaaggccttcaaaagcctgctggccatagtgaagggctggtgagctttctgaaatgtgcaattccgcatcttcggtcaactgcccttcagaccattggctgtttttgaaatgagcgatgaagcggtaaggtagtttcatataagaaaaaccaaggttttcccagtcaatgttcactgtcatatagtttctccaaattcattttttaatattttactacttttgaaagtgattttcaattaaaaattcagaaaattttgtgaatataagaaaaagcctggtaaaccagactcttactctttaaaaacaaattctagttgaatttcaggtgagatagcactaaataaattttgatagtagtttttggctgactcttttatgtcttcctgataatctgctaaaaacttttcttgctctaccgactgaaattcatctgtgatgagttgggcagtatcgatttcttctgtcgcaaaactcagtatctcaccactcttatcatataaggtataaggttcttctgcatctaattccaatccaatgacttcaaaggctggaagggtaattttgtaccgattttcagaaagatgttcaatggatacaggacttttgataccaaattttgctttgtacttgataattaagagggctgatttttctgagaagggcatttcttgaccaaataagaccgtgtagtttttagcggtcacaattttctggacagctgtatttagaaataccaattcattgacttgctcgacagactcaatagccgcatggacactcacttcctgctgattactcttttcaccagagatgtagccgtatccccatacaccacacaataacagaaggaaggacagaacaagccatagatagacttttatactgaaaaataatttgataattttcatagcatttacctcctctacagtatagcaaaaagacttctttgcgagcaatcttttcatcttttttagtctatccaggctctgaagacttcttcatcggaaatggtatccgaaatgaagctaccgttgctagtgcgttcagacaggctaagctgggtcacatcaacctcatagagtttgcctgttttggactgcacgtgaaggatttgacttgtcgtatcatcttcatttgccgtgctaaagagatcaaaatcaccctgatccgtcaagactggacctgccgcaaagacacggtgaggcttagccttgagttcgcgaagcacctgcaaaccacgcttggcacggctggtcacagggatttcctccgtcgccatccgcttaaggctaccacgctgggtcaggagatagacggagctggtattgctgataaaggccgcagccaccacatcctcgtccttgaggttaaccgccttgacaccggccgccttggcaccgatgattggcacttcttcgatgttaaatcgcagagcgtagcccttttctgtcatgagcatgatgtcatccaagactacaggcgatacagtaataaccacatcctctgcatctttgagtttggcatacttggttgacttggacttgtaagtccgccatggcgtgaactccttccgctccacacgcttgatttgaccgtatttggtcaccgcgaaataagtcccctcttcaaaattctctaccaattcagcgaagataatctcttcattggtatcaaagttcatgagagtctggctcaggtgttcaccaatgtccttccaacgaatatctgtcaactcatgaacaggtcggtagataacatttccaagattggtaaaaagcaagaggtgctgagttgtcttggcattctgcaagaaaatcagctggtcatcatcccgcttacccatttcttcaagcgttgaggcattgaaagaacgaggacttgtccgtttgatgtaacctgccttggtcacgctgacaaaagtttcttcctcgacaatcagactggcagtatcaatctcaatcgtttctgcctgatcctgcaattcactcaaacgaggattgccgaactgcttcttgacctcacgcagttccttcttcataagattgaacatggtccgctcatcgccgataatagctgccaaggtctgaatctgctcgcgtagggctgcttcttcattttccaaggtcacaatgtcggtattggtcaagcggtagagttgcaaggtcacgattgcttctgcctgctcctcgctgaactcatagctgattttcaggttttccttagcatccgccttgttttcagaagcacgaataagggcaataacctcgtccaaaatggaaacgacgcggattaaaccctctacgatgtgaaggcgtttctctgctttttccttgtcaaacttagaacgggcaatgataatctcacggcggtgggcgatgtagctggacagaatcttctgcaagccaacctgacgcggtgtgaaattatcaatcgccaccatgttaaagttgtaattgatttgtaggtcggtgtatttgtagaggtagttgagaatggtttgctcatcgctatcttttttcagctcaatggcaatccgcagacctgtccgatctgactcatcacgcacctcggcaataccaggcaccttgttgttgacacggacatcatcaatcttcttgaccaaaacagccttgttgacttcatacggaatctcagtaatgacaatctgtttcttaccagccttgagttgctcgatttcacaacggctacggacaacgacacggcccttaccagtttcataggctttcttgatttcgtcagccccttggataatggcacctgttgggaagtctggtccaggcaagaactccatcaacttttctaacttagctgttggatgatcaatcatgtagacaacggcatcgatgacctccgctagattatgcggcgggatgtcagtcgcgtaccctgctgaaattcctgtcgctccattgaccaagagattagggaaggcagctggtagcacagtgggttctttttccgtatcgtcaaagttccaggcaaatggtacggtctttttctcgatgtcagccaagagatagccagccatttccgaaaggcgagcctcggtgtaacgcatagctgctggcggatcgccgtccatggaaccgttgtttccgtgcatctccaccaaaatctcgcggttcttccagtcctgactcatgcggaccatggcatcataaatagaggaatcaccgtgcgggtggaaattccccatgatatttccgactgacttggcagacttacggtaacccttgtcaaaagtgttgccgtccttattcatagaataaagaatccgacgttgcacgggcttgagaccgtcacgaatgtccggcagggcccgctcctgaataatgtatttggagtagcgaccaaaacgctctcccatgatgtcctcaagggacatgttttgaatgtttgacataaattaagatacaaagggacgattcagtcccgtgttcagttatttctactaaccgaacattcctttctttgtttcttggtgggaagttaaattttctttcttttttacttttttgataatcaccttaagtagtgggaacggaagagagcttatatagcaatttctgttgcgatatccttaactaaacattagttctttacctaagttctctgataaaagaaagcaatcatatcccctactctatcataaagattgtcatcaacatatgctaatttctcaatttctaattcctcatcatcaatcaaattttcttgataagcttgagcatattcaccacacgattttagataatccattattaaaactaactcttgcttctgttgagaagaaaggagttttcctttatagagagtctcctttatgaatcgacagtagtttgagtgctcttcacaccaattgacattgccatttgcttgagcttcccagcgaagtttttctaattgtcgaagtaattcaccttgtaaagtagaagaaatcccgtatttaggcacatctgctcgccaaattgaacgtagaacctctgtatactgagaagcataaggaactttcttaagttgctcgatagttggcttttttcttaaaaactttatcatagctactcttccgccttccactggcttgcttgccagcttctaaagtcatcgacatctgttttgattaatttcaaacaggcattaaggacaaaggcatcgtcaagtagacctgctccaaggatgaaatctggtaaggcatcaataggactgaaaaaataaatcaaagcacctataattgcgaggattgtcgctttgggtaacttgctgtaatctctacggatatagcttcgcaccatggaaatcaagcctggaatagccgcaaacttatctccgccaaaaggcatacgagacagtttccgttccgtgctatgtaaaaaatgttctaattttccttgctcagatagcaagttttctgcatgttgccgagttttggaagattgccaaatcttcaatgcttggccaaatttctcttccaactcctgtttgtttttaaatggcttgcgctttcgtgcccattcagacaaccgtttttgaaaacggtcagttaattttactcttagtggcataaaacacctcacatcatttgtttatgctagatttacaaatcctcaatacgatataggttgtaaccctcatagtaataagaatggtcgatgcccttgaaataagtagcctgaccaagatcttccgttaaggcttgcaataacagatatttaagctctcctgttgacacatggcttctaaccattgcattgaaatattcatctttatcaatgctattccagtcaacaaccctacccaaactatcccgtagcatacaatccaaccagatacgcatactgcgtccatttccttctcggaatggatgtgcaatgttcatatctgcatatttttcaacgatttcatcaaaggtttcgtgaggtagcttgtcgatataggccaaagactgctcaagaaagatacgtggagcgaattgaaaattatctttggttggcaatgttgacatcacgaatcttacctgcaaagtcgtaaatatcctcaaataaagcttgatgaatgtgtgccaaaccggcaaaggttccaacttctatctggaataactgaccattttcgaacagttgagctgcttttttcttgctgatttgttcttcaagacgggctaattcagccgaattttcaatctccaatttattttctaaaaccatatggcacctcaacttccctgagattatttagtaaaagctgtcgattcctccaaggtaaacttaacattgtcttcaatcaacttgcggcgtggctcgaccttgtcgcccataaagacagatacacggcgttaggaacaatcgattcctatcacaaatcatcgaattgaatagtttatagtattagtttgctatattttcaacaaattgatagaccttttgggaccaatctgccatcccatcctgaccatagtctaaataataaacttttgaagacatatctaggggaataattgtctcaaaatgagatttttcacttgaaggaacaatacaggcaaacaaatatttcaaacttaaacaatccctgacctttgcagggtggtatccatcaaaaacataaccatctgcattgactatatcgtcgtacttaaaatgaaaacttacgcctggaataaaagaattccccaactcttcctctgttggttctctacctagtaatctttccattgcaagtctgtagccagaacttgtatttgaccaacctagcatgacataatcaaaataatcttctggatcacctgctgcgtttcgattatcctgaacgagttcttgatgagttttgttgaacgcacgaacagcggacaataattgaccactcatgaaaatctcttgtgcagtttcgacagtacacgtatgacttaaaaaatccgaataaacgtaattaccaccaacatcatatgttgaggccacaatctttttcgaaggagtaaatggaaatgcagtgggtgagcaacaagataaatagacaagttgttcaagcattactttgtcttcacaatctattagcgtctctctgccgtaaagtttctcataagctaaaaaagctacaattttctctaattcccaatcttgaatattaggatagtcagacaaagcaagaaaataggttcccttccattggagactataagattcattccaaatttgtaatttcataacgtagtcttacaattgtatttcaatttctaaaacaccgtactctcttccaaggtaaacttcacattgtcttcaatccacttgcgacgtggctcgaccttgtcgcccatgaggacagacacacggcgttcagcacgggctaggtcttcaatggtgacacggatgagggtacgggtttcagggttcatggtcgtttcccagagctgatcggcattcatctcaccaagccccttgtagcgctggaggataaagcccttgccaaaatccttgcggagatcttctaattctccatcagaccaagcataagcaatcttttctgcctttcccttgcctttggacatcttgtagagcggcggaagggcgatataaacccggcctgcctctactagcggtcgcatatagcgatagaagaaggtcagcaagagggtctgaatgtgagcaccgtccgtgtccgcatcggtcatgataataatcttgtcatagttgacatcttcgatagtgaaatccgacccaacacctgcaccaatggtgtaaatcatggtattgatttcttcgtttttgaggatgtccgccatttttgccttggcggtattgataaccttaccacgcaaaggtagaatggcttgaaacttgcggtcacggccttgtttggcagaacctccggccgaatctccctcgaccagatagagttcatttttggctggatttttggactgggctggggttaatttccctgacaaaaggcccttatccttcttgtttttcttaccgtttcgggattcgtcacgcgccttacgcgcagcctctcgggcgtcacgcgccttaatggctttacgaactagattagatgctagctcgccattttccaaaaggaagaaggtcagcttgtccgacacaatgccgtccaccacagggcgagcaagcgggctacccagcttgtccttggtctgtccttcaaactgcaaatgctcttctggcacaaggatagagaggaccgcagacaaaccttcacggtagtcagagccttccaagttcttgtccttttccttgagtaagttggtcttacgagcatagtcgttcatggccttggtaatggctagtttgagacctgtttcgtgggtaccgccgtccttggtccgaacgttgttgacaaaagacaggatattgtctgaatagccgtcgttgtactgcatagcaacttggacttggaaaccagcatcttctccttcaaaataaaggacaggtgtcagagtttccttgtcttcgttgaggtaggatacaaagtcctgaacgccattttcatagtgatactcctcctgctcacctgttcgctcatctgtcagagtcatggtgacttgcttgagcaagaaggctgattctttcaggcgttcggcaatggtgttgaacttgaaatccgtcgttgagaagatggtatcgtcaggcataaaggtaacttttgtacctgtttttgattttggagcggtaccaatcttctctagggtcgtgactggctttccgccctgctcaaaccgttgcttgtaaacagctccgtcacgggtaatctcaacttccaaccagctggacagggcattgaccaccgaagaaccaaccccgtggagaccacctgaagtcttgtagccaccttgaccgaacttaccacctgcgtggagaacggtgaagatgacttcaactgttggcttgcctgttgcatgcataccaacgggcatcccgcgtccacggtcggaaacggacagactaccgtccttgttaatagtcacgtcaattcggtcaccgaaaccagacagggcttcatcgacagcgttatcgacaatctcccagaccatgtggtgcaagccatttccgtctgtggagccgatgtacataccagggcgtttgcgaacggcatctagcccttccaatacctgaatggcatcgtcattgtaattatttatatcaatctctttcttagccaaaactgacctccatacttatcatcctttctatattacaagttttttagcatttttgcaaaatatttctgttacctatcggctgagacagctcacaaaataagattttggactaaattagatgaaaatatgctataatgaaaacatgttagtcaatcttattttactatttattgcatatttgttgggatctatcccgtcaggactttggataggtcaaacttttttcaatatcaacattcgtgagcatggttcgggaaatactggaacaaccaacacattccgtattttaggtccaaaggctggtacgattgtatttgtaattgattttctcaagggaacgttggcagccttgcttccgctgatctttcatgcccaaggaatttctccgattgtatttgggttaatggctgtactgggacacactttccctatctttgcccaattcaaaggtggaaaggcggttgcaacatctgctggtatgcttctgggcgtcgcacctgctttttgcctctatctcgttctaatctttgccagttcactctacttgacgtccatggtttccttctctagcgtcttagcagcagctttagcaatcttaggagctctgctatttccagcaataggaatcatcctgccaagctacgactggctctttacagtgattatcgtctttcttggcagttttgtcatcatccgtcacaaggaaaatatccagcggattttgaaaaaagaagagaaccttgtcccattcggactcaatctaaccaaacagaaaaagcgagtttaaccactcgcttttaattggttctgttgcaaagttttaaataaagaataaaatcccttacggtatctatgatttaagctgggattcccaataataccttgatttcagtacagaccgaaaacccgaagagagtgccttcttttcgggttttcttatataatcctcgaatggcttccatgcctttaatcgtggtagaggcagtgcgtaaacttcgatagaatttattgcgtctctttactggacgatggtcttgttcaatcaaattattcaggtatttaatggtacgatgttctgtcccttgataaaagccgtattcttttagtttcttaaaggcacttgtaatagagggggctttatctgtgactacaaccttcggttcatcaaactgcttcactaaccgcttaagaaaagcataggctgcttgtgtgtcccgttttttacgtaaccaaatatccaaggttaaaccatctgcatcgatggctcgatacaaataatgccattttcctttaattttgatgtacgtttcatccattttccatgaataaaaggattttttatttttctttttccaaatttgatagagtagtttgccatattcttgcacccaacgataaatcgtcgtatgagaaacgttaatgccacgatcatataagatttcttgaacttcacgatagctaaggttataacgaagatagtagcccacggctacaataatcacatcctgctgaaattgctttcctttaaaatgattcatcgtcattcctcctgctatctttttctattattctaccttatttgatagtagatttaaaactttgcaacagaaccagcaggtacaataattgttgaataaacatcatcattagcagagaatttcaatgctccaggagtattagcagaagctaatgaggtatcataagtcacagttatattgctattattagcattaacttttgtcggatgtgaaaacgtaacactctcgcccggttcaatcgtatatttctctaacacatcaccagttgtcctacttaccaactctgctaaaacagcagttgttgacgaatcattatccaaagagtaacgaatgtaggcatcaacttcagctcctttataagttgagctagccatatttttattatatgagtacaaatcgtacgattcaaaagtataccaatttggctctgatgtcgctttaattccatcttgagttcgaagtgtatgtggagcaattgctgcaccatttggctcagccattgaaggcgttgctgttgtagtgctatctagaagggtaccttcgccatcaccaactttcaatgttgatgcagttgtatcaggtgctactgtatcaagagccgctgtcaagagaccatctacagtgtatttttgcaattcattccctagcgcctcgttggctactttaaccgctgcgacttgcgcttcaacttgctcaacagttgcttctgagtcagccaaaattgccttagctgctgcaagttttgtttgagcatcctctatagcttttgcaagagttgcatcttcagttttagccaactctttttgaccaagaccagccaaaagtggtgattctgatgttacctgttcaagaacagctttcgctttttcaacttctgttgaagtcgtagctactgcactcgtattttcagcatttgttttttctgcttcttctgcaaccgcttctgttgaagcaggcgctacactactggcaatagttggttctgatgaagcaacagtttcatcagccttaacaacctgtgcaccagcacctaaaactaacgacacaccaagcaaaacgcttgctgccccaaaatgatacttacgaatcgaaaattgttgtttcgtaccgtaccagtcaaatgattttttatttgatctacgcataaaaaatcccccatataaatattaatttaattacacaaattttctactctttgtatcaaagccttgaaaactcccgcaatcattcgaggtattatactacaaataactttaaatgccaagtaatattataaaattcctcaaaaaaacattatgaattcgcttcaattcaagaagaaaccagtatattcatagtttttacatattttttaagaaatttcacttttgagaatttctataaaattaccgacaccgcaaaaatattagctccatatcttgtattcttatacatataaccaataataaatagtcaataaattttaaaaaaatctgcctgttttctgatacaacaagcagattttgacgttattccttttcttgctctcttgccaaacgctcacgttccaaacggagtttgcgattgggattgagcctgttaaagagttcttctaatttttcagcattccaaacatcggctgctgagacaaaatttccatacttatccttgaaggatattggcttatcacccatacagacctccaactattttttttaagattgctcacaaacgactgtcaccaactgaacgaaatttgtaaagctatagtctgctctcgaatttctaagttcatactagactaacttaccggacaggttacgatatggagtacaggcagtcgataccactgcctgtgcggaattagtaaggttggtaggtagtccgccatagcggctaccgtatcacatcaagtcctttaggattttgatgtgattccaaagttacgacacggaacccaaatggttgataccaccatttgggtgaagttagtaaggtagctagccaagatcccataggacttggcgtagtttaactagcaagttaacttgcagtcaaactgctacgttaatcaacgaactcaaattcgaacttgccaatacggacgatgtcgccgtctttggcaccacgcgcacggagggcttcatcgacacccattccacgtaactgacgagcaaatttcatgacagattcgtcgcgatcgaagttggtcatggtgaagagcttttccagcttgtcaccagatagaatccaacttgcatcgtctgcacgactgattgcaaattctggttcatctgggttaaagccatagtaagcctcttcttcttggaaatctgattcgtcgtagagcaagaattctggcgttttctcaagcaactcagctgtagcttctagtagattttccagaccttggtgagcaataccagaaattgggaaaatctgtggcaattcttcaaactcatcatagttggttgccaattttttcttgaactcttccaaatgttcttctgcctctggcatgtccatcttgttggcaacaataatttgagggcgctccattaaacgaagattataggtttccaattcattgttgatggctacatagtcctcgtaaggatcacgaccttcacttgctgacatatccaaaacatgcaagataacacgtgtccgctcaatatgacgtaggaattgcgttcccaatccaacaccttgactagcaccttcaatcaagccaggcaaatcagccactgcaaatgactcaccagacttggtccgaaccattcccaaatttggcacaatggttgtaaaatggtaggcaccaattttaggtttagctgctgtaataacactgagaagcgttgattttccaactgatgggaaacctacaaggcctacatcagccaacactttcaattctaattcaagattgcgctcctcacctggttctccattttcagaaatctcaggcgctggattcttaggtgtcgcaaaacgaatatttccacgaccaccacgaccaccgtgggcaatgacaaattcctgcccattctcaaccaggtctgtaatgattttacctgtatcagcgtcacgcacagttgttccctgcggtacacgaacaattaaatcttccgctcctcgaccgtgcatacctttggtcatccctttttcaccatcatcagccttaaagcgacgattgtaacggaagtccatcaaggtccgcaagccttcatctacaacgaagacaacatttccaccatgaccaccatcaccgccccaaggaccgccattaggtacatacttttcacggcggaaggcgaccatcccgtcgccacctttccctgccttgaccttaatcttggcagtatctaaaaacatactcataatttaccctattctttcctagaaaaaaacgcttaaaagcgttttagacctgtattcacaagcgaagtgcttatatataagaaatcgtttttagccaatcaaggtggttttttcaaaatactgactgtattttgaaaaaaactaacgatgagtgcttaaaaactagccttagtatagaagtgctgaacagtgaatacaggttcttaattcatcaatgcattaatagctggtaaaatcaagccagccaatgtcgctacaaccatcacgacaacgattactaaagtcactttctcaaatgttgtttttttgtgtttttcttcaccaaaagccattactttctccttatttagtcattgatagtttattctaacacattatgggaatgttttcaaatctcatcctttgaagaaaggctttccttgaccttttccgctactttatacggcactcctgcttctgcgatttcttgtagactggccgactggatattgccaatagacttgaaatgcttcatcaaagtctgcttgcgttttggtcccaagccttctatgccgtccaatttggatgagaaggaattttttgaccgaacctgacgatgaaactcaatagcaaagcggtgaacctcatcttgaatccgatgcaggaggaaaaattcctgtgaattgcgaggcaactcaactacttccagcggattaccaaagagcaattcgtgtgtctggtgcttgtcattcttctgcaaacctgcaatgggaatggacatacccaactcctgctcgatgacctgcttggcgacattgacctgcccctgaccaccgtcaatgataatcaaatcaggcggtgtcaaaccgtcccgcagcacccgactgtaccgccgctgcaaaacttcccgcatggaagcatagtcatccggtccctcaaccgtattaatcttgtacttgcggtattcttttttattaggcaccccattttcaaagacaaccatagccgacacaggactagtccccataatattggagttatcgaaagcctcaatccgcacaggcgtcggaatccccaaaagctgaccgatattctccaccgcaccgtaggtcttctccagatttttctccaaaagattaaacttctgctccagactgacacgcgcattcttggttgccagattgatgagttgcttcttctcgccacgctggggcttgatgaccttggtatctaccagagcttctacggcttcttggtcaatatcctgcggtatcaagacctctgagggaatcaaatgttgctggtccctgtaaaactgaccgatgtaggtcaaaaagtcttcgcccgcatcattatagtatggaaaaagattgacattccgctcaatcagtttcccctgccgaacaaagaaaacctgcacacacatccagcccttgtctacgtagtagccaaagacatctcgattctgcaagtcatgagccatcacacgttgcttggtccgcagggttgaaatggattggaggacatcccggtattccgcagccttttcaaattccaaattgccagcagctgccttcatcttgtcctgcacttccttgataatcttatcatcatgacctgtcaagaactgggccacttccttggccatcttgtcatagtcagacaggctgggcatattgtctccatgagccaaacattgccccaaatgataataaagacaatacttgttctcaggcaatttacacttgcggaaaggatagaggcgctccaatagtttgagggtctggttggccgcacccacatctggatagggaccaaaatactgaccaccatccttcttaatctgccgagtaatgagcagccgtggatgacgttccttggtaatcttgatgaagggataagacttgtcatccttgagcatgatgttatagcgtggcttgttttcctgaatcagattgatttctagcaagagggcctcgatgttggaatccgtcacgataaattcaaaatcggcaatttcagccactagagcctctgtcttggtatcatgggcaccacgaaaataagaccgcacccgattgcgtaggtttttggccttgcccacatagataatcttaccgtacttgtttttatggaggtaacagccagggctatctggtagtaactccaatttatgcttgatcaaatcgttcatagatctattatagcaaattttctgataatcgagcttattgcattccattttacactcgacttcttgcaatatatccgcatccatactacaaaaatattgatagaaactattgcttttgtactaattcagcagtataataaatgtaattaattgtatatattattcgaagaacagtggaataaggcttggaatacctagcaagcccctacttttagttcacgaataacaaggaggttactatgatacaatttgaccatatcacaaaaacatacggcgaaacaatcgcacttgatgacctaaatttgacaattgaaagcggcgagattttcggtttaattggtcacaatggggcaggaaaaacaacgacaatcagtctactgacttcgataatcgaagccagttatggaactatctctgttgatggtttaaacctagaggagaaccgcgatgaagtcaaaaaacggatagcctatgttccagattcgccagacatcttcctacacttaacagcatttgaatactggcactttatgggcaaggtctatggtgtagaaaaggatacagttgatgaccgtatcgctaaactatctagtctatttgatatgacagcgcgccaacatgagcctattgacagtttttcacatggtatgcgtcagaaaaccattattattggtgcattgatccctaaccctgatatttggattttggatgaacccctaactggactggatcctcaggcctctttcgacctaaaacaaatgatgaaagaacatgctcaatctggtcacaccgttctattttctacacacgtcctttcagtggctgaacaactctgtgaccgcattgctattctccgaaaagggcaactcattttcgtaggaagtcttgatgaactcaaatcacagtatccagataaagatttggagaccatctatttggaattagctggacgccaacaagtgaaggcaggtgaggaagtatgagtaaatccatcatttgggaactagtaaagattaatattctttattccaaccctcaacttctagcttccgtcaagaagaaacaaagtaagcgcaaagacgcctccttttcagcctataaaagtgtcctcttgcaacaagtatttatggttttgagtttcggacttctctactctgtctttttcatgggagtagattatagtcagtctatcggtttcttttctctgcaactagcgctctttaccattattgccattgtctacggttttacaggtttcttctccgttttctacgatagtaaggatacaaaattgtatttagcacttcccctgaagccacaagaagtcttcctcgctaaaatcctctctgcacaagggatggtcctacccttcctcatgccgtgtctgtctttacttctaatcacttactggcaaattggcggtccgctcctcgccttagcttccattccttcctttttgattctctggattttagttaatttagtcaatctgattatcatgcactttgttggggaagttctgacaaaaagccctcgtaaaacattgatttctacaatcctgatgacaggttcttccttgctggcttttgctgcgctcatgttcctgcaatcccagcagaccgtttcactcgaatccggtggctttgttgattttcctatcatacctatatttgctggattccattacttggtcagccatactatatcactagaaacactccttcattttggacttcctttcattttgatgtttggacttattacgtttgcgtttaaaactgtcattcccaactactttaatcaagttttggcgattgaaaatgcttcgacaaaacggaccaataatgctaagtctgccaagattcctagcaatctcaatcaggctttagtgaaacaccacctatctactcttaaagatagcaacctcatggtccaaaccatgatacagcctatcatcatgggggtggcactttttccaagttttagccgtttcacggagaatggtggtctaagttcagttgaatgggatttctttggtattgctctattagctggattcttgcttggcagtctatttgctggttctacaaccttcatcggagtagccatgtcattggaaaaggaaaattatcatttcattcgaacgcttcctattagtttcaaaaaatttatcatccaaaaattctgggtattggctgcggtacaattcgcactaccaactctactttactttgctttggctctaggtttcatgaaagtcaaactcattctagcagtcttctttacagtcggcatcatcatttcagccctgctaactggtcagatttattactggcgtgaccagcgactcctcatgctcaactggcaaaatagtaaccagttatttggtcgcggagcgggtcaatggttgattgctggatcgatcataggaacaatgtttctcggagccattattctagttgtcagcatcatattagctggcactattggtgcagcttatgtaagctcagccttgatgaccttactatttgttctatctgctgctcttcaactttatatctacaaagcttattggcaaaaactaaaatagattggacaaggccttgtccaatctattttagttttctgcgtaatattcctgaccgtagccttctacttcagcattgatttgccaagagataccaaacttgtctgttacattaccataggcaggagaccaaggaactgcttgaagttccatattgatagcagttgcatctacggataacttgctgtatagttcctgcgctgtctcagcatcgtctgtgataagcgcaactgtaatattgtcacctactgtataaggcatttctgggttgttgtctgacaacataaaacgctgaccattcaaacgaaactgtgcattcattacgtaattttctagttcagcagggcagtctggtaagaaatctttaaatagatttacttgctccactgttgccccaagagcatttttataaaactcgatggcttccaaaccattaccattagtaaccaagtatacttccattgctttaagcatgatggacctccaaaattatgatggtttattatatcacgagttagttatacggacaaatttttcgacttatttctgactaaatgtaaaattagtagtctccacctggtacaccaaaatattcttccaaggtcaagcctgaattgtaaatatctgtcgcttcttgaccaatatatcgcacatgccaggattctgccatatagcctgtgctagactcttttcctggaagatagcggacaacaaagccatatagatgtgcattcgtagccaaccactgagaagcattaggctcttctaataaattaccacttgtatccaataaatcaaaggctaatcctgtctgatgttcactatatccagctcttgcagaatacctatctgccgctgcttgtccttcctgatttacataagactggtagagacttgactgagtttcataggaacgaaatccactatagttattggagataccaaatcctagcgcctgcatatctgctattaatcgttgaaaagctgctaaggcttcaggattttcgcccggtgcataatcagctgcaagcggatgctttttatttacaataatcacttcgccatattttccttgtacactataataggaaccgttaaaatttacctgagtctctgtacttgttacttcttgattcgtttccgccgatgtagagctgcttgttgactgctccgaagttgttgaagcagactgacttgaagtagtcgaaacaactgttgacgaattttttgtagtattggcctgatttatattttgatgacatgctgctagtaacagtattgtcggcaagcataatagaatagtacgtttcattatcatcaccccgttctcttataattatgtctattgtagcacaatcataagaccccgtctaatgacggcttatgattttaactactattgatatttttagtattcattgaatttctctcgattcttttcctttcaaatagtggcattcctgataacatacatgtcataaatagaaacaccagcctttcgactggtggacatatatgatgttaaatagtcgtattcacaagtaaagtgatttatatacaaaatagttttttaggagatactgactatattttgaaaaatccatcttagctagagatactgaactgtaagtacaactagatacctcatcagtagtttctaaacaaacattatttttgatttttagatgacataccgtttttcatgatgtcttctaccttcacatccggtttattatttagcactcctaaaaatacaagaatgctaaggatgatacaaatcgtctgctcgatttggtttaaggtacgactacattcaatattaaaataacaaaataggacattatcaacgagcatcaataccaacgaaatgagtccaatccaaaacatatgtttttttaaacgattctttatttgtttcatatctatactcctttttgatgtataaaaatacattttaacataaataaaccgttaattcaaaaaaatatgggataaaaaatatgataaagcaatcgaaatttgactgaatagattaaatatatcagcacaataaaacgggtgatgataccaagttaatagaaactacgtatcatcatccgtttgtcagctgtagggagaaagaaattttatccgattagcttgatgtccgttcttctcattgtttaccctgcaataaataatgagaagaaacttgtaccaaccatatccgcaagagcatgtcctaagaaatatggcaataaattgtcatttttccttgtgtacatgtagtaatagaaaaggccgaaggctacaccaataacaagagcagataccattccttgataggtatggaaagatatacggacaattgttgaaaagagtaagaccagcgaacgctttttcttatctgtgctcaacaataatcctaagaaaaagaactcttcatagaagccattaaacaaggaatagataactgtgctgtagtcaacggctaggaaacggttgagcactgtcatgatattccagtcatagtaaggcaagtatccgaggaaattatacccaccagacagacctggaatatatgaaaaagctgtaaatgtcaaatcgctaatcaggcccgcaccaatgaaaatcagtggtccccagagtagaacggtccattctaattttacttttagctgcttgaaatcataattccgaatcaataaatacaccagggcaaacaggaataattttccttgattggctagagcccaccaattatcggctggactaaacgacagaactcctgtttcaacggtttctgttgcagaaaatgatgctatccattgcatggttgaggtataaatagcattaccacataaaatcgttgtgataataatcaaatctatccaagtgagttcttttaggggctttgttggacgaatgcgtctcagtaatcttttcactttttcctccttatatttttgtatatattctttctgtataattatatactaaaatccttataagtttcttaaaatatcttataacaaatctaataattcttgatagctatgaatggtataggttggaactgccttactattatttatcatgtgagtcggattataccaaacagtatccataccagcattatttccgccttgaatatctgctgtcaaactgtctccaatcattaaggcttgggcaaattgaaaacctgcaatctgctctgctattttttcataaaaatcagtcgcaggcttttgcgtccccatctgctcagaaataaatacttctttaaaatacgattgaatcggtgagtgaagcaagcgattttcctgtatataggtcacgccgttggtcgctgcataaatctggtagcctcggtgtgtcaattcctgcaaaagcttatctgcacctgtaaaaatttgtccctgccgcccaataaactcttggtagcgcaaggccatctcccttccatcaacttgccgaccaaagtgggcaaaggtccgtgaaaagcgggtgtttattagctctttctttgtaatgttccctttttccaaatccttccacatgctctggttgagcggtcgataaacttctttaaaagcttgaatatcttcaacctccatagctgtcaaaaactgggttaaggctacttcttctccacggctaaaatcaagaagagtatggtcaagatcgaataataaatgtttgtagtgcaattttgggattttcctctctaaaaacaccctctatttgagtgaaatcaattcgtttctaatctatagtgatcatcgtaaaattcatttttaagaaccgctcctttttaaaccgcttagcctcagatatatcttggctttctgtattttatcggcagatagcccttatatcagtgtgtattatcttgatagatagcacaactaagtattcaagtatagacatcttattgataaagtttttgaattcaactagatctttatagtaataattatatcatactaaaaaatacaaaggctataattttccatcaaagtttcaatgtgaaatatttaccctctatccacaaatcaagtcttctaaattaaatggaaaaatatatacatttgtaaaattataaaattttctgattcaaatttttaatttacaaatttatagtgatacagaaaggagaacctcgtccgcttcaaaaagattaaaagaatagaaacagaactacctcaatctgcaatctctcacaaacttagaattagactaatatcgttcaataattaggaagcagtatagaataacattataaaaaccaagcggttaccaggaatctcctagattgtaatttaagtacatcactcctgtttgtaagctatgaactcttcgggagtgagaaaaacgtcatcatagcctagtgcttgacataattgcatcgtggttggctgagatagataggctttttcaaggacatctttctgtgaaaaaacctctcgaacacttccatctaacaaaacttctccttgtgcaaagacaagggcacgttcaaacgtttctgctacgaagtccatatcatgcaaaatggaaataactatttttccttgttctctcaacaattgtatcaccgattgaatctgtttttttcctgcatcatcttgagcaatcgttggttcatcaaaaatcacaacctgtgtatccatagcaactattgcagcgattgacaccatttttctatcggataatcctaagtcgtagggatttaccttgtcaaatccatctaagcccagcaaggacatagtttttctagctgcctgttctgcttgagaatgagtcatgcccatttgcaatggtccaaacataatttcatctaataccgtatgtttaaaaatttggtcatctggattttgaaaaatgagtccaatacttttagcaattttagcgacagattgttcgcttaaatcttgtccatttaacataattttaccagccgtcggacgaataaggcctttcagtaactttacaaatgtagtctttccagcaccattttgtccaataatcgccgtcgaacgctcatctaaaataatattcaacccttttaatatttttttatccggatgataggaaaattctaagttactaatactaatttgattcatacatttccccccctattctttgccaacaactgactagcttcctcaagtgtcacaggataataggaacttcctggtagcttcatgcctaactgcttgcatattctagtaaaggtaggtgctacaactccatacttttctagatctggtcgagaaaacacggcttgtggtgtatccatggcaattagttttccctgatcaagcaacattacccggtcactgtaagctgcgattttttcaaccttatgttccaccataattacagtgatgccttgcttacttaaagactgaatagctttgaaaactgcctcactaccttgtggatcgagttgagaagttggctcatctaaaataatgacctctggtttcatcgccataatgctagcaattgccattcgttgcatttgtcctcctgacaagtcaaacggagctcgatcacggtactcttcaatgtccaacaaacgtaaactttcctcaattcgaacttccatttcttcttttgggactccgaaattctccaaaccgaaagcaatttcttcatacacagtcgccttagaacctgtaatttgattaaatggattttgaaaaacgcttccgactttttggcacaagtcatcaacctctaccctcttcacttcggattgatcaatccatacctttcctccatacgaaccacggtaaaaattcggaacaagtcctgttaatgattgacagaatgtcgattttccagaaccatttcgaccaattaccccaatgaattcacctggacgaatctcacacgtgatgccgtctagagccaacttttcagcaaagggatattggtattttagattttcaattttaatatgtgccattatagaaccctccagacaattgctagcacaactccaaaaatgcagaaaatttgaatcaatcgatcaaattgcgaacgaatcggtggattgataaatgtctttttagattttgaattaaatcctcgaacctctaaggcaattgcgcgttctctcgtatcaataaaagaactcataattacaggagagaccaatggcaaaaaagcttttagccgaaccaacatcgaaccttctgtttccatcccacgacttctttgtgcatccgtaattgttgccattcggctcgtcatctgagggattaattggaacaaggagacaaacacatatcccattcgaggtgagaagccttttctaactaattcttcaatcatgtccgacgattttgtcgttaaaatcagaacacagaaagctaaaataatattacatacatttaaagcaatctcagctgcaaatatcaagccttccttataaaaaatgactggacctaattgaaaaacaggcgtgacattaccacttctaaacaatccttgaataattcctaccgttaaaataacaaacccagatacactcagaatgggtaaggtctgccttaacactttagaatgtgctaacaaaacgacacttaaaagaattgtaatgctaaatacagctaaatcacctgcaataatcggtatcagaatggtcgcaagcacatacaacatcttagttaacggagacaaattattcaaaaatgaattcttgtcttcaaacaaactcatcgttttcatggagacctccttaatctaggttcttaatcacactattactttggtaaagcgatagtagactctttggtaaactcttatacaagcttagcacaagtaataatacgactattttatctggaatatctaccactatttcatccataaacgatgcaaaccaaactgggaatttttgagctaatagacctgcataaaccaagtctccccataaatttccggttgtaccaccccaaaagatcatattcaatggcgttgataccaagactgctgcaaatccagcaacaattcctgtaaataaggcacccctgatgttcttcatactaccgtaataagccaataaaccgactgcaattcctagggctgcattggttaaggcataaactgtagaaatcggatccaccgttaatccataaattaaattattcataattcccacaacagcacctacaattggaccagccaaacaagccgataaacaagttccaatcgaatctaaccaaagtggtaatttgagaacccccgcaatcaatttaccaatataattaatcccaacccctgccggaatcaacactaaagctgcagtattaaacttcaatgataatggattattatttctccaattcatgattctatcctttcctttgttcttctagcatcacaatcgcttccaatgtcgtaagaatttcatttttttcaccttgtgtcacacgattttcgccagacacatattggttgatctcatctttcaattcaccatcatatagtgccactgtatttaaaatggagcccgttttaatcccacgtaggctaccaatagtaaataaagctgcactttccatgtctccagctaatacaccttttttagaccaaaaatgatcaacttccaactcattatcaatataaaaactatcatggcttctagcaattccaacgtgatgggcaaaaccttggttcatagcagttcctcgtaaggcaaataaaacatcagggtctggaaccgccggaaaaattggatcaacatacgccctagaagtcccctcatcacgtacagccccattcaaaatgaccaaatctcccatctgcatctccggttgcaatgctccacatgagccaatccgaatcatacattccacaccgatacgtgccaactcttctaccgcgattcctgttgaagcaccccccatccctgtagaggtaactaacactggaacccccttatagcttccacgcattgttttgtgttcacgattgaatgctataaattctacactatctaaaaactctgctactctgtccaccctctgtggatcgcccggcaatatggcgtatcttgcaccttgttctatgtcacaacgaatatgtggttgtagtaccatctttctttctcctaatctagtaaactcgttaaagcttggtggtccaatagttgaatcttaccatgacctaaatcgatgatttgcttttctttaaattcttttaacaatcgattgatactccgttgggtaaccgccatctcttgactcaatctttccgaattaaactgtaatgatgctaatttttttcctccaaattgctccagcaaatagtatgcaagtcgctgtctaagatcatatagactattgcgcttcatacgattacacatacgataggaattttcacaaatcttcttaataaacaaactactaaagttttgatctaatgccatccaactcgaaagtgtatctttatctatttccaaagcgataatatcaccaactcctttcacataactaatatacggaacttgttgaaatatttccatttctccaatcaagtcaccagactgactacaacaaagaaaatattttttcccattttccgattccgagtaaacattgaccctcccctcaacaataatatacatatactgatagatctccccttgctccaactcaaattcaccatcttcgaatctcttgacatgtattttacgcaagatttcatatgggcaaagctttagtaatgaatatacatctggattcatctcgattatatccaatagtagatgcattttcaaaatcatacacgctcctttctttattgttaccacaacaatgataacactttcttttttgcaagtaaaggaattccgtccgattcaatagcaaaaaaacatatccaatgtcataatacacaaacattttaaggacaaatgtcttcttgttttacgatttgttccagatttctaagccatactttataaataaattttgataaaatcttcctaattccaagagcttttaaactctaatttgtattacttaacttctactcatttcgaatgatgaatgtttgtattgctaaatgcggattccattacaaaagatgatttaattttttgtgaagtagtcagattttctgaaatatttaacacttatttatataacataataaaattgcgctatttttaaggcttttgatttttgtaaagtagaaaaactatttttcttgccactaatatcaactaagaattcgttttaatatcaaatgaaaagacccaaattgattagggattttttagtatttgtttattagattctacttgattaaattttaaaatcattgcttgcatcccatccaccaatatcttggttgctttgtaggggtcttcagcatgggaaatggctgagataacagctatgccatctgcacctgcttggagaacttccttacaatctttagcagataaccctcctatcgcaaccatgggaatatcggaattgagtttccttaattgctttaatccatccattccaatggctgggctagcatcatccttagatagagtaggaaaaacaggtccgcttccgatataatcaactagatcaataggcgaattgaggtattcttcttttgttccaactgatagtccaattattttccctgggaagagctgtctcgcttctactactgacaaatcttcctgtccaaggtgtattccatcagcatcaatggcacgtgctaactcaacatcatcattaatgattaatggaacctgatagcggtgacacaggtgttgaacttgttttgccaacagtagtttatcagcccctgttaaaccttgctcacctttttcacgaaattgaaaacaagtgattcctgcctgcaatgccttttccagtacatccaaaaatttgccttttggacaatctgacgtgccacaaataaagtaaacttgaagcatttttctattcataatgaatgacctttttattttcttcaacctcttctgattggattgcatagaggctatttataaactcaatctggaaggttcctggtagtgaggttttctgctctgccatttctccagcgatcgaataagccgataggacctcttccaaacaatccaataatgaatcctcatcagccaggtgaataaaggcagccagaactgctcccagcaggcatcctgtccctgtcactagtggcattaactcactaccattttccaaaatccgaacctgatgattcacagcgacagcatctttttttcctgtaatcacaacaggaattcctaattgttggttggctctgagagcaagttcacctacattgtcaatctgagcagaatctacccctttcgtttcaatactttcaccaatcaaggctgcaatttctcctgcattcccacgaacgagtgaaatagtatgatgatgtaacagatccaaggtaactttcttgcgataggcaccagcacctgccgcaacaggatctaagacagtaggtacaccatatttctcagcaatatccaaggcagatttgtatagttcccaagtttcattggtcaaggttcctgtattaatcaataacccctttgtatagggaagtagatcctccaaatcttctggatactcgctcattgcaggtgaggcaccgagagcaagtaagccattagctgtaaaatttttgactacatcattcgtaatacaaatggtcaagggattttgactacgtaatttttccaaatacatctagttactctcctctgtaggtggtatgattgacaggaccatttccatgccccagttctagagcagtctgaattgcttctgtaataaatcgtttggcagtttcgactgcttttgctactgtccgacctttcgccaactctgcagtaatgactgccgcgtaggtacaacctgtaccatgggtatggttcgtagaaatgcgtgctgcactgatgacactaatctcaccatcttctaaaaataagtagtcagatgccgcctttgccagatgtccacccttaatgaccacattttttaccccaagttctttccgaatccaacggcccgcattcatgatgtcattttcacttttcagtgttctaccgactagaacttctgcttccggtagattcggtgtaatgatggtagcaaggggcagtaattttgttttcagcgctttgattgcatcctcttcaatcaaacggtctccactcgttgcgaccataacaggatccaagacatatggacacttctgttttgcaagatagcttgcgacaagctcaatggtctcgacttgtgctaacattccagtttttattgcatctggaacaatgtcctgaaagacacttttcaattgttcttctaaaatttcctgatcaagatgacgaattagttgcacccctttggtattttgagcaacgacactcgtcacgactgccataccataaactgatctagcctgaaagctcttcaaatcagccataatgcctgctccgcctgttggatctgttcctgctattgataatgctacatgtaaagatgtcattttctatcctccaaaattggtattaattcacttaattgcttgatgctaactatacctgtattctcatcagaaaaaggggaatttggatgttctatataaactcccgctattcctaactcatgtccaatacaaagattgttcttattatcctcgaccattacgatattggctggatctatccgttcctgatgtaggatgaattggtaaaactccctatttttatcgcttccaaacagattcaaactgctaaatagtttcacaaaatagtttgaaagatgatgggatgacaatcctagttcagccagctccagatagtttgaagtgactgcgtacatgactgcaccttttgccttcaatgtagataggagttcatgcacaccatccatcaaggaaatatctctatatagtgattgcagttgattcattttttgcctttcaagttcattctcatctaaggaattctccacaagttgcaataaatacccgttgacatcttccattggaatacgccaaagttcttcccttatctgctgggtataagcaaccccgtgatgtttcaaaattccttgaaccacctgatcccagaccccataggaatcaaagataacgccatcaaggtcaaaccaaatgaccattttgttcatctatatctcctttctctttttctcggtgaaaatgtaaattgaaggggctaaggggatttgtgaaaatactattaattgtattagccttatcatcagtttcgccttgtcgaactctacgaaagtgacttattgcgcatatcttatttccatcgtagtatagcctctaggctggtcgagctacctgcactcaattccgtatttctgagaactcttcattcgacaatagaaaaaactccatctgatggtttatcaaatggagttacacctacgatgattgatgaccagtaaatacagtattctatactagaatacaaatatagtacttgtcaacaaaatttgttgatacacatttcccttcggcagtcctaactgcatcaggttcgatgggtataatctcagcctcttggcaccccaaatgttctattcaattttacaaaaatactttatcatattttcgagcttactgcaattattttttaactaaatttaatcttctttacttatcggcgctaagcttgccaagacttttttgagtcccatatcagggaaattgattttgagttcttgattgctgcctgaacctgatacttcaaggactgttccgcggccccatttcttatggactgcgatgtcaccaactgaccagttggtgcctgagcttgacgattggttgcttgatgcgaagggcatactacctccgagcttggcagatggttgtacggatgcttttcgactttgtagggcttgttgcaagctcatgccttgtccaaactgtgtcgctctgccattgacataagaagccttaaagctagtattagctggacgagcgaggccttgataatcaagcaagtcactggaaatttctcgaataaagcggcttggttggttgtagttggtgcgaccgaaaaggagtcgagaattggcattggtcaggtagagagtctgctcagcacgggtgatgcctacgtatgccaaacgacgttcttcctccaattcgtcctcttcttctgctgcacgactaagtgggaagacattttcctccataccaatcaagaagacaactggaaattccagacctttggctgcgtggagggtcataagagtcacttctgaagattctgtatcgccatcatctgtgtcagcaatcagggccaaatcaagcaggaagcgtgttaatttatctagacctgtctcttcttcctcaacatccttttcatcaaagtttttggtaacagaaaggaattcctggatgttttcaatgcgggcatttgcttccagggtattttgtgctgcaagggcatcgatgtagcctgtttggttcaatactgcctcgactacttgggtaaccgtcaagttgtctaattgattgcgaagattatagaggagattggctaggtcaaagactgcctgcgctgccttgcccttgactggtgacaacataatatcctgagaagcttctagcaaggacatactgtggctggtcgcaaaatcacggagtttgtcaaccgtaccaggtccaacgccacgtttgggctcattgacaatgcgttcataggagatattatccgatggatttgcaatgatattcaaataagaaatcacatcccggatttccttacggctgtagaacttggttcctccaaccatggtataagggatattagatttgagcagggcttcttcaatggtacgtgattgggcattggtacggtagagaactgtaaaatccttataagccttgccttctcggtgcaactggtcaatctgccctgcgacaaaaatcgcctcgtcattctcatctctggcacgatagtaagtaatcaaatccccttgggcattctgtgtccagagttttttgggacgtcgattgcggttgttttcgatgacctcattggcagcctgcaagacgttcttggtcgaacgatagttttcctccaaaagcacaaccttgctctctggatagtccttttcaaagtccaggatattttgcatatccgcaccacgccaaccatagatagactggtccgcatctccgaccacgcagatattcttgaaacgtgatgccaggagcttgactaattggtactgggcatggttggtatcctgatactcatcgacatggatatactggaatttctgctggtaataggtcaggacctctggattttggtcaaaaaggcggagcgtcaacataatcaaatcatcaaagtcaacggcctctgactgtcttagttccttttgataagccgtgtagcatttagcaacaatctgcgtgtataggtcgcctgcctgcgcttcaaatgccttgtcatcaatcaagtcgtttttggcattggaaatggtgcccaggatagaacgttcactccactttttcggatctagattgagattttttaaaatccgtttcatgagactgcgttgctcacctggatcgacaatcgtaaaattgcgattgtaaccgatatggtcagcatcccgacgcaaaatccgcacacacatggagtggaaggtagctatcaaacaggcttgcgtggcaggattgagggcataggcccgctccttcatctcccgtgccgccttgttggtaaaggtaatggctaggatattccaaggattgaccattttttcatcaatcaaataagcgatacggtgggtcaggactcgcgtcttacccgaaccagcccctgccataatcaaaagcggaccttccgtcgtctgtaccgcttctgcctgtctgtcattcattccgtttaataatgggttcattttctcatactttcttagaacatgtattacaagtggagtgcttttaaataagagatagtttttcgctaatcaaggcagttttttgaaggaataccgactgtattttttgaaaaacaaacgatgaatagctgaaaaactaggcttagatggaagtactacactgtgaatacaggttcgttataatcattctctccattataccaaaaaatctctcgatagacagttcaatgtgatagatggcaagcaaaaaaagcccagagtcatctctgagcttttgtattcaattaattattcagcacccaaggcagctactgtgatgtagttgtatggtttgttgaagtgtggcaagaagaacaagtctgtcaaggccaatttttcgattgttacaccttcttggattgccaatgagaagaggtggatacccaatgagatgtcttcacgagcagccatttgcgcaccaaggatacgacgtgaatctttatcgtaaacaatcttgatagtgacagggaagttgccgtgctccatgaattctggtttttggttgtctgttacttcagtaacagcagcgttcaaaccaagacgagtagctttttcaagtgtcaaacctgttgatacaaggttaagaccgtagatagagataccgttagaaccttgtacaccgataccttcaaggtcagtgccacagatgttgtgagctgctacgataccagtacgtactgcatttgaagccaaagcgatgtagcttgtatcgccagtagcgttgtcgtagattgttgcacagtcaccgatagcgtaaacgcctgggatagaagtttcttgacgtttgtttacaaggaaggcaccattacggaagcgctcgattccttcacctgcaagcgcagtgtttggacggaaaccaacagccaagataaccatgtcaacatcgtattcgttcttgtcagtgatgattttctcaactttaccattaccagcaacttctttaacagtttcgccgaaggcaagtttgataccatgctcttccaagtttttagccataaggtctgacaagtcacggtcatagtacccagccaaacatgtatccacaacatcaataagtactacttctttacctttacgttggaatgcttccgcaagctcaacaccgatgtaaccagcaccaacaactgcgacgcggttgatgtctttgtttttcaatttttcaataacatctgctgagttttggtacaatttaacaaattgcaagttttcaagagttgcttcaaattcaagcgaaccttctttgatttcagctcctttgattggtggtaagataggttgtgaaccagttgcgaaaagaagtttttcaaatgattcaacatgttcttgaccatttacaagcgctgtaactgttttggcatcatagtcaatgtttgtaacaggtgactccatgtatactgtcgcacccaagctctccaactcttctttgtttgagtagaaaagtccttcaggaccgccaatttgctcaccgatccacaaagccataccacaacccaagaatgaaatatttgagttttggtcaaatacaacgatttcattttcttgaccataatttgtcaacatagttttgattgcggcagtaccagcatggttagcaccgacaacaacgattttagccataatgtaaaatctcactttcgaaaatatatttttttacgaactatattatacaatataaatgttaccgatttcaaaaaatatgctcagaatatcacatttttttcaaaaagtttttgaaatgctattttctttaaacaatgtaaagatatataaaagcaaaaacctagatttctctaggtttctcttaacgtacttgttcaaaacgcagatgtacaataatcttatcgccatagccgttacgttctaaatcacgttgcaagcgataggaaatgtaatgctcagcaatagaaatataccctgcatctaaaagacgatgttcaacttgcgactgaaccatgctaatcgttggtcgctctgtatgagcttcttccaagtcaagcactactttctttgtgacctgagcaagatttttccgccaagtttcatcaatgacatagactgtctgtgcagctttaatgatggcttggtagattttatctggatcaaattcaacaatctctccactacgtttaatgacttgcataaaagctcctttctggttttcagtaaaccctttcatacttacattatctaggtttttgtgtattttgtcaagtattctttttcataaattttgccttggcttattttcgctgaaagccctttagtatgatataatggacctattaaaatgaaataaggagaaaatcatgacaaatgcaatgcctaaacgtcaagaaattgatgtgcaattaacttgggatacggacattctatttccgacccctgataactacaaagaaaatttggcagcctacgctaagcaagtgacagctttcgaatcgaattacaaaggaaagctaactgataaggataccatcgtttccgccttaacagaatacgaaaaaatcgttattcttgatagcagactttcccactatgccttccttcctttggaagtcgataagatgaatactgaattggcgagcctggccaacgaatacgacctcgtttctgccaaggcacgtcctcaacgagatttcctctattcagaacttggtcaattagatgaagcctttctacttgaattaaaagaagaacaaccacaatgggctgcattctttgatgctattctccgtgacaagccgcatcaactgcacccacttcaagaagaacttttatcaaattttgcaccaacatttggtcagccctataacaactacggtgtgaccaagtttgaagatatgacatttgaaaacttcgaggcaaatggcgaaacgctcggcaatagctatgtgctctttgaaaatgattatgagctcagccatgataccgaaatccgtcgcaattcagctgctggtttctattcaaccttgaaaaaatacaagaatacaactgcagcaacttatttgtctcatatcaagaatgagcaaatcgaagctcgcttgcgtggatttgacaatacgattgacttcctcttgcatagtcaaaatgtctctcgtgatctcttcgaccgtcagattgatgtcatcatgaaagaattggctcctcacatgcgtcgctatgtaaaattggttgctaaggctcatggattggacaagatcacacatgctgacttgaaaatcagtctaccatctgaatacaaccaacgcatcacacctgaagaatccaaacaattcttgattgactgcctgggcattcttggtgaagattatgtgaaaatgattgaacaatcatttgatgagcgttggattgactttgctcaaaacgaaggtaaggctactggtggcttctgtgctactctttacgatggaccatcttacatcctactttcatggacaggcttgatgaacgaggtcttggtattggctcacgaattgggacatgctggtcatttccaattggctaagaaacaaagtgtccttagctacgatccatccctctacttcatcgaggcgccttctactgcaaatgaagtcttgacatgtaacacccttttgaaaaacaaccaagaccctggcttccaggcttacttgattagcgagttgatcagccgtacttacttccacaacatggtcactcacttgcttgaagcagccttccaacgtgaagtctacactcgtttggacaatgaagaatacctcaacggtgatattctctgccaaatcaagttggatgtcatcaaggaattctggggtgaagactttgaaatcggtgacgatgcaggtcttatctggatgcgtcaaccacactactacattggtttgtatccatatacctactcagctggtttgaccatcggtacggctatggcgaaacaattggaagaacatcctgaagaagttgttgaaaaatggttggaaaccttgtcactcggtgcaagtctttctgcccaagaccttgctaagcacgcaggtgttgacgtttcaactgaccaaccactcaaagaaaccattgcctatgttggttcattggtggataaattggaaacactaatctaagacacataaaagacttgaacttgttcaggtctttttgtctattctttcttgataccaatttcccacgtaggtcaattcatcctgacttaaaaaatgtcccttgtcaaaacgaactaggttggctctgggaaaagctgacgcttgccagtcatctacaagatgttcaagagcgacttggtcgacgagttggtcattctgccccagtgtaaataaaatctctgctctgctattttccataggaaaagcgtaatctaaggccgaagggtggagcaagatataattgtccgccaggtttgactgcttggccaacaagcccatgataaagttagcaccgtttgaaaaacctacgaaagtaatctgacgataatctcggatgtccaagtcctgccaaaaatccagaaaagccgacaagcgcatttcaacatcgacaagatccagctgaccgtcaatgagaggtgcaaagaaacgcctttccctgccttgaccccaacttccatctaaggaaaggacaaaagcttctggatccagctgttagcgaagaaagagcatggattccttgttgccacctgtgccgtggaaaaagaccaaaagactgggactggtccctttgataaagcgataatccatacttcatttctcctaataacgttgggagagatttttttcgatttcctgtctatcctcttcaaagaaacttggcaaaaataggtctacctgatccaactcttcattctgagctggcatttccgattcgcgctcaccagtcatggttgccacctcaaacataaggtaatttggcgctcggaagtacaaggaatgaatgaaatctcgattaatgataccagaatgtggacgattgatgagatttaagcgactaatcaggtcttccaagtcggactcatctaagacaccaaatgcgatatgatgaatggccccgactcccataacgctgattggcgactcttggtcaagtatcaaataaagtcgatgttggaaggtgttatcaaagagaagagaaatcactatcttatcctcaaagacaaatcgactttcctcaacaaatccgaaggtttctgtcagcaaacttagtaatgccttttcttcacgtattcgcatgtgaagactggcaatgccaagaatagcgtattccgacggaatttcatctattttatacggaaacatttctccgatagcgttatgataggtcaagccaagcaactggccatcttcatcttggaaattcagaatatgcccatttccaaaagcctgaattccttcattctccacttcaaactctgtcagtcttttctgccagaattctaatgcctcaaaattttttaccagaaaaacagttctttccaaacgattggttccgtttcgatgattgggatggttaggcatatcaaaaatggtaaattccgttccatagcggccctcttcatcaccgaaaaagagatgatacatgcttgaatcttcttgattgacagttttcaaggtcaattttaagccgagaatatgatgataaaaatgataggcttggtgtatgtttcctaccaagcttgaaatgtgatgaatacctgtattgttcataagatgacctcactgatgttgatagacatattttatcactaattattgataaataaaaatcttttgctcacgattgacagccaagtaataaaaaacttccctaaccattgctgattagagaaggatattttttaaaaaatgagaccataaaggagagccgcaagcaagcctccgatgattggaccaactactggtacccatgcatagccccaatccgaatctcccttgtgcttcaatggaaggatggcatgcatgatacgaggaccaagatcacgcgcagggtttagggcatatcctgttggaccaccaagagaaactccgagtgagacaatcaaaccaccgacgattaaagtgccaatccctgttggaaaatcatactgaccgaaagccagtaatcccaagaccaaaacaaaggttccgattgcttcgctaattgtattagaaacaaggttgcggatggcaggtccagtagagaaagttgccaacacagcaccagtgtcttctgttgcatcgtagtgatctttgtacatgaggtagaccaagatacttccgataaaggctccgataaattgagcaaggatgtaagggactacagaagcccatgggagatttcctgcaaaggccattgcaattgatacagctgggttgaggtgggcagttcccaataaaccactcacaaaagctgccatggctactgctagaccccaaccaattgtgattacaatccaaccagcatccttggccttactcttatctagtactactcctgctaccacaccattacctagtaagacaagtaaggtggttcccaacacttcaccgattaattcatttgtcatcatgcacctctttctatttttctttcaaataggtcaaatcattcttaacaagtgtatctgccaacaattgtttctgttgagcaacttcttcctctgaccaagcataataagctaccatttccttaatgatttcaagcgcaactgcatccaactgctcacgcataaagagcatgtagttggtacgacgaagaagatagtcaactgcagtcaaggtcatctcttccttcatagcatagtgaagggaaagcaaatcacgcttgttcaagccagaaacggcttctactttatggtttaatacaaagacttttggagcatttgaaccgtacaagtttgccaagtaaagggcgtcatcataaaggagacctttcttcacacctagttgagcaagatgttcaatttcttctgctacgtttgcagggttcaattcaccaccagagactggataggtcttagaattgatgagtttgaagctgcgaccatgttcttctttgagaatgtctgccactttttcaattgcaccttccgctatcttacggaagtcagtaatcttaccaccagcaagagtcagcaaaccattgtcatcacggtcaagggcagagccacgtgatacagctgaaggatccaagtgtttttcagaaacgctgccttccagatgggtcaaatcatgttccacatcgtcacgtgtcttttcattgttcatataacctttgaccgtttcaatcaagctattaaagctgtcatcgctgagcttaccgttgtttccaccattgtagtcagaagcaccatttccagacaagaggggacgaagacctgcccaaccactctcaatgtcatccagggtcaagtttgcttctgggaagcgattgttgacaatatcaagcaggtagtcaacatcttcttgggttaccattggatttgccaaatcaccagtatagtctgtatcagtcgtaccaaaataggttttattttcacgcggaaggacaaagaccattcgaccatccgcatggccagtatcaaagtaagtcggctgtggtacagacaagcgagagctatcgacaactaggtgcacacccttggtcggacgcatctggagaacgcctgaaccttctccacccagattacgcacttcatcactccatggtcctgttgtattgatgaccaaacgcgcacggatttcaaaggtgcggtctgtcagcaaatcacgagcgacgataccgacaacttttccagcatcatctttgatgaatttctcagctttggcacggctggcaatcaaggcaccatccttggctgcacgtttgatattttcaataaccaaacgagcatcattgttgcggaaatcaagatagacaccgccaccaatcaatccttcttgcttcaagtttggttcgcgttcaagtacttcttctcttgtcaagaccttattggccatatcggtattattgacgccagccaagagatcatacaagtccatggccactttcaaacggaagaggctgaaggtagaacctggctcatcatagactggtaaaagcattgggtctggctttggaatatgtggggcgatattttgtactacagcacgttcagatacggtatcggataccacttccacgtcaaattgtttgaggtagcgaagaccaccgtggaccaatttggttgagcgactggaagttccttctgcaaagtcctgcatttcaatcaaggctgtttccataccgcttgctgctgcctgcaaagccacacctgcacctgtaataccacccccgataatgaggaggtcaagttgacgatcctgcattcgctcaatagctaagcgtcttgtttcttttgaaaattccatacgattcacttcctaactttcgaataggactgtctagcaagcagaaattcttctttcccctagctaacaagtcctttattgctcttcatccacttctgcaaatagttgagttgctgcgacagcttttttccatcccttgtaaagttgttctttacgagcttcgttcatggttggttggaaggattggccgacagcgttgagttctttcaattcatccaaatctttccagaaaccaactgctaaacctgctaagaatgctgctccaagagctgtagtttcaaggttttgagcgcgtgcgatttcaatacccaaaatatctgcttggaattgcatgaggaggctgttcattgctgcaccaccgtcaaccttcaagacagaaatatcaatacctgtatccaattgcatggtgtcaataacatctcgaacttggtaggcaatggattgaagagttgctttgacgaagtcttctttagtcgtaccacgagtgagaccaaagactgagccacgcgcatctgagttccaatacggagcaccaagtcctgtaaaggctggaacaacatagacttcatcattgctggtagacttacgagcaagctcttctgactcaggtgatgtagtcaccattcgcatgctgtcacggagccattgaaccgccgaaccagcgataaagatagatccttcaagcgcataatagactttgccaccgataccatagccaattgttgtgagaaggttgttctgtgacaactgcatctcttcacctgtattcatcacgatgaaggaaccggttccgtaagtatttttcaccatacctggctcaaatgctaattgtccaaataaggcagcctgttggtcacctgccatgccagagattggcacttctgcgccatagaaatggaatggagctgttgtgccgtaaacttcagagtttgaacgaacttctggcagcatggcttttggaatattgagaagagataaaatttcatcatcccatttcaactcttcaatgttgtagagcatggtacgagctgcgtttgaataatccgtcacatggcatttcccatcagtcaatttccaaaccaaccaagtatcaatggttccaaagagaatctcacctttttcagcacgttcctgcgctccagggacttgatctaaaatccaacgaactttggttgctgagaagtaggcgtcgactactagacctgtcttttgatgaatcatatctgcatgaccatccgccttcagctggtcagcaatatgagctgtttgacgagattgccagacaacggcattgtagattggaagacctgtttccttatcccagacaacggttgtttcacgctggttggtaataccaattccttcaatctgatcaggacgaacaccgctttcgataaaggaccctgcaatcacagactgaacagaattccaaatttcattggcgttgtgttcaacccaacctggtttagggaaaatttgcgtaaactctttttggtaactgccaaccttttcaccttttttattgaagataatggcacgtgaacttgtagttccttggtcaatggccatgatatatttttcagtagacataggtctccctcctgtttgtttatctttttttgaaaacgcttccattttcttggtaattctattctaacccattcttgtgaatttttcctatcatttttttcaaaaaaataaaaaaatctgataagcagtggctagaaagatgattctatcaactgttatcagagtttataaaataaatttttcaaggttaaatgcacttacatttttcacaaagactatctgacatcatctagcgatgctcgataggaaaagaagttttggtcgccataatctctgattgacaggacttttgatgatatatatcctgtatccatgcctttaattgtacgatatcttggattttcaatcgatttcctaggcaataaactggaatgcttgtattttcgaggtaatctgtaataatcaaatcatagtcatatcctgcttgatagggctcaataagaacctgacgattgccttctaacttctcccttagttgcaacaagagaggataggatagaacctcatgtagggaagaagcaaaagcaaccttgacctgtataggctggacctgaccaaaataaatatacaaatccgcaatatttgtcagataagagttccttatttttttatcgacttttctatgaaaaactgatttatagacgtcttttagcaagtcttctgcttctgaatagaaactagaagcttctacctcttccagttcaacggaagaataaaagaaatatagctggctcatgatttggttcaaatgatagagcgcttcttctgagactggtaaatttccctcaaaatataaccgtaatttctgaagagccaaagaggtagcttccataatcggtccaccgaaaccaagaacctgctctaattgatgcggcactaaaataaaatggctaaacaggaaagcaaacaacgccataatttccccttcttggaaagaggtggattgttgctgacttagtgtaaaatacatctttctcaaacgtcggtaaaacttatgttcttgatagggttccatcaatttgtaaaggtgcttaaaatctagctgtcgcaatcgagagcgttgctgtgaaatcattaaccacaacaacagacgatgggcttgcttgggatttagcggcgattgatagaagcgttcgaaaaccggcaataaggcctctattttccctagcataaactcttcttgtaattccgctctcgtagtagtcaaactcaacatttgatgtaaaaagtaccgtatttgaagctcactaccttttagacgaccacttttgattccaataccaaattctgccaatatctggttcaaagaggcaagatggcgattcagagtcgcttcgcttatcagcaattcttgagccagctgttgaatagaaacctcttccttatcagataaataaacaataatttgatatttggtactggtttgacagagatagtctaggatacgatgaagactcaaactggcctttttcttcaaaaagaccttttcatcttcgagttgaaaagagagtcccaagtcggttacttctgcttcttcattgaaagatacaatatagcgaaaaagagttaattttgacaattctaaatagtgacaaatatcctttagcgatggcgcctctttcctatcttctaagtagaggagaagctgataaatggcgagctcacgcttttccaataaggaatcaatccgcatagacaccctccccatcaacctgataaaattgccgaatatactcttgagcggcctctacgatgaaggggaccagaggagtatttccaggaagacagagccaagaatgttctaccaagtcaaagacggtcaaatcctttgaaatcgctagagacagtacatccatctgttcaatataatctgcagtagaaacgagttgcccccctatgatgcgcccactcgtttcttcgacaatcagcttgaaatctactaaagttggttcccactggctatacgaccttctaatccgaatcgatttactctccaaccacaagctcgcctcactctcggtcaagccaaggctagttatataatagccaaatacatgactagaaacaatccgctgggctctcttaataggagcaatcctcttttgcaaatttcgagcagccatcctccctgtcataatcgcatgatgaatcatcggaagatatgcctgtccaaaataatctactgggagactgaccaaatcacctacagcaaaaatattctcttgacttgtttcaagaaactcatccacccatacagtcccttctgcaatcacttttagcctgtctttcactagctgaatattgggcgtcaaattggtggatggcaagactaaatcagctggataattacctgtgactgtatgacaaaccagctgttcttcctgagtatcaatcgttatctgattgactgtttcggataaatgaagttggattcctctttttttcatctcttgacgaatcggcgcaatcatatcctcatcaacgtactttgcaaggagtgaatcttgcgcctcaaacacatgcaaattcaaatccaactggctaagggcatccaagctttccaaaccaatctgtcctgctccaatcactgcaactgtttttgcatttgtcaatttctctagactagcttgtgcttgagatagcgtttttgagcgaattagatagtcttgaagttcttccgttccccattcccatgtttgactagctcccatagccaatattagccggtcataaataatatcacctatatcttgatgatgccgtatctttacctttcgcatttcgggataaactgcgagacattctgtttcaaaaagacaagaaatagctgcatgctgcacctcgctgaacaaagaaatcttcgcttcttcccaaccagaaatttttcctgccactttccaattcaaggtatttggaaagtaagccacatctttttctctatcaattagtgttatttgagcattctgatacaattttcgacattctaaagctgcacttaaaccagcaaaggaggcgcctataataacaatattcatacttaatccttttatcgtttttagtcattatatcaagaatgaccaaaaaattgaaaaggcttgcaactgaaaagcacaccagataactgatgtgcttgtgtaaacttaaataaaacgaggaagatggccagaagctcctctagattaatatttttctaaacacctcactctttatgccctaactcacgttaaaatagtcactcccctgactatcctcgctttcgcatttcttggctcgggtcttctatggtcactttcatatttcttggtgaccagctgaaacagttccccgaactgtttcactcccccagacattgttcgctctcttatttcaaggctcacgttaaaatagtcactcccctgactattttaataatccggtcttacgactcctgtcacagtggctttggtcgcttcgtagtcgccgtccactacgactttgataatgcgtttagcatcttcttctgggcatggaaccaacggcaagcggagtggaccaacttcaaatccaaggtaattaagaaccgccttaactggtgcaggacttggatatgagaagagggcattgactttcggaatgaacttgcgttgaatagcggctgctgttcgaatatcttgttgttcgatggctgtaaacatttcatacatctcatcaccattcgtgtgagatgcaacagaaatcacaccatctgctcccaagttcattgcatggaaagcatcgccatcctcacctgtataaatcaagaagtcttctggtttatgctcaattaggtaagccatgttagcaaggctggtacactctttaacaccgatgatgtttggatgctcagccaaacgcaacatggtttctggcgtcatttcaaccacgacacgacctgggatattgtagataatgattggcaaatcagaggcatccgcaatagccttgaagtgctgatacattccctcttgagagggtttgttgtagtaaggcacgatagcaagacctgccgcaaagccgccgaatgccgccacttctttggcaaactcaatcgagtcgcgcgtatcatttgtaccgatacctgcaattaggggaacacgaccattgacaattttttgcacagcaccaaatagttccagttcttcctcgtgtgtcagggttggactttcggcagttgttcctgctaataaaatcccttctgtgtgatgggacaacagatgttcaatcaattcgggtaaaacttcaaaattaatcgaaccatcttctttgaaaggggtaatcattgctgtaataatttttacatcacgtaaatcttgaatagacataggcttcctctcttactgattgttgctaaaaaaggctgagtgcagccttttgtgtacttttggttaataaaattatttcaattcaaacttcaattctgccgttggacgaactagaccacgctcatgaagggtttcagcgatttgaacagagttccatgcagcgcctttgagcaagttgtcagaaacaacccacatgtgaataccgttttccttgtccaaatctttacggatgcgaccaacaaaagtatcgcgactaccaacagcattaatggcttgcggataaatttgattagccacatcgtcttctaaaacagcccctgggaaggatgcaatagctgccttcacttcatcaatcggtgcaatttccttagtttcaatgtaaacagattcagagtgagctgacaagactggaatacggacgcaggttgcagaaacggcaatgctgtcatcttccatgattttcttagtctcttttgtcatcttcatctcttcgtatgtgtagtcattttcagtgaagaggtcgatttgcggaatagcattgaacccgattggatagtgcttcttatcgccaccagaaggaagaatattcgcttctaccgctttgggttccacgccatcattcaagacagaacgaagctgagcttgtgtttccaagatagctcccatacctgctccagagactgcctgataggtggatacgatgatccgctccaagccccatttctgacgaacaggctccaaggcaaccatcatttgaatggttgagcagtttggacaagcaatgataccattgtgggcatcaagcgcgtgagcatttacctcaggaacaaccagaggaacatctggattttgacggaagtaagaggtattgtcaactactacagctcctgcttttacagcgtaaggagcgtacttggcagatgtagagccaccagctgagaagagggcaatatccactccttcaaaggctgtttctgttgtttcttcaatgacaatatcctgccccttaaactgcaaggtcttacctgctgaacgggcagaagcaaggaaacgcactttctcgattggaagtgttgactcttccaacattttaatcatttgggcaccaactgcaccagtggcaccaacaacagctactacataggccatagaaatctcctttaagtcaattcttcaaaattttctaaatattttatatttaacaattatatcataattttttcaaatgaaaagccctgagaaagaatttcccaaggcaattacttcgaacctctattcaccagtttagatggacatgctcaactgtgaatgctcttcttatttatctaatgagcgaacatagtagtcaactgccatcagagcttctgcaacgtcttctgctgaaatagcaaatggcataccgtgaattgtttctccttcaatcgtcgcttgttggccgactttcaatagttcttcataactagcatcagccaaatgtaactcctccaaagttgttggaagattcaaggcttgatagaaacggatgtatttttccaattcttctttaggacggttttccaaaaagagctgggtcaaggtcccataagccactttttcaccatgtgtcaaatggtgaatgtctccctccaaggcggtgaatccattgtgtatcgcatgcgccgcagccaaacctgcactttcaaagcctaaaccacttagcaaggtattggcttcaacaatattctctaaagcagctgtcacaaccttggcttcacagctggccatggcttgaagtccgtattcaaagagtgtttgttcacaggtttgtgcaatagcgataccagcaagtgtctgacctcctcctgccattgttgttccattgctttgtaaaatagcacgcgcttccacccacgtcgccaagccatccgcaataccagaagccaaaagacgtggcggtgcttgacaaataatcgctgtatctaccaagacaagatctggatttttcttatagaaaatatagcgttcaaacgccccttcttcagaataaatgacagataaagcagaggtcggagcatctgttgaagcaatagttggagcaatgacaactggcactcctagtaaatcagcaatcgccttggctgagtcaatcgtcttgccaccacctagaccgattacgacgtcactagcctgttcttttccgatttctacgacgcgctggatttccttgtcagatgcttctccattaaaggcaacacgatggacttgcatcccttcttcaacgagataggacaaaaacttctcaccgataatcccatatactaaatcatcacaaagaatcaaaggctttgttcccaattttccgatagcttctgcaccttggaaaaggacatgtttaccttgaatatagcgagatggacttgcaaatactttcataagaattcctccttgaaataatagatagtgttatattgagtaataaacgacagtgagcattgccgaaagtaagaggtatgagcctgcattttaaatattgccattgtacagcgatgcctactaacaacgtgtcgagccatcttctcccatctctagtgcaatttccttgaaaactgcctccagcgacaatagattgctagagttggcagacaaaagcaactgttgactccacttcagtctggcttgaaattcttctgattcctgtgtcaaataggtcagaagcaagtagaggacaacatttcgtttcaatggctcatccaccaaatcctctcttctttcgctgagctttgattctatttgttgaatcacgtcccaagcatcactaggcaggtctaatgttacacaagtagaaagaacttctaagacatcttgtacttcttttgataatatccgagcttcaaaattctctatagcttgaagactacttcttaataaaacgctttcaaaatctctgataagaatatcatctatcaagctgaatagatgatttctttgtacttcttttatggctgctagataaagaagagtattgaccactccatttatcaactccgaggtaggttgtgtcaataattgctccctatccgctataattagctggatggactcattaaacaatggtcgctctcttttcttattttccaccgatacccaaggtagagtggtaaactgtgaagtcggtataagaacagctggcaagtctagtaaatctgcaacagcctttgtacaagctgccacagaactattaccaatgccaataatatggtctgcacgatgtcggaaaccaacttccccatattcttcaaccgagttctggtcccactcctccatataggctattttaacaataagtccatgacaagttaaaactttcacaaaactttctacagttgtattatactcctgttttgcacataaaacaaggggacgatgacctattttcaaaatgtcaatcgcacaagtgtctaaaagatgatttccttggatagtgcgtgaaagacctgagaattgtttcatagtgcccccctattttataatatagaaatgtttagatagtataccttccatgaatggcagaccaatcatctgcaaaatcatttaccgccttttcaatggatggcatagaaaaggctgcttcaaatatatctgcacctgccgtaatagcctgcgccccatttgcaaatgcttggttcacttgatccacatttttgaatgatgctgctaaaattttactttccgaacactccctatcaatcgcttctgataactgagcgatgaccgcattcgaatcaatattcagattggccatgcgattgtagtacggcgctaagtaatctgcacccgcttcaatagctaacaagccctgaaaaacggtataaatcgctgttgctgtaatctgataaccttgcgctttcaatgttttcatagcagccaaaccagcaggcgttaccggaaccttaatatagatattttccggtgccaattcacgaatttttttagcgtctgccaaaatcccttcataatcctttgccacaacttgcacatgtagtgaagcatttggaccgatgatgtcacggataaggtgcaaacgttcaaaaaagtcaatgtcaccttctttcctcgcaatcgttgggtttgaggtcacccccgcaaggggtaaaacctcagcccattttcgtatttcctctatatttaaggtgtccagcatgaattccataataataacctcttttacaatgtatgttctgtacgaccaatgatgtcgtcttgtgttgctctcgacaatacattgaagaatgctgaataacctgctacacggacaatcaaatcacggtgtttttcaggatgtagttgtgcatcaatcaaggtttctcgagagacaacattgtactgaatatgatagccatgcaagcggttaaagaatgtccgcaagagggcaattaatttttgtttgtcttcttctttggcaagtgtttgtggattgaccttctgattgagcagaacgcctccaacaatttcatgtgttggtaatttggcaactgatttcaaaacggatgtcggtccatttttatccatattatgtgatggagaacaaccttctgccaacggtgttcctgcattgcgaccgtctggagttgccaaagtaccacgcccctgtccaacgttggctgaaatggatgatgtacctgaatagcggataccaccaatcggaccacgaccaaagcgagtgtttggatatttggcaatctcattgatataaatatcatatgctgctgttaccaattggtctgcataatcatcatcgttaccatattttggtgcatcttcaatcaacatttcctggatttctttaccacgctccccagcatagtctgtttccaaagcatgccataattcttctggagtcaatcgtccttcttcaaagactaattttttgattgctgctagagaatcagataaattggcaatgccaacctgcagaccagaaatgtaatcgtaaatcgctccaccttctttcaggtgcttaccacgaccgatacagtcatctgtcagagctgagcagagaatgtctggtacttctctttctaaagcaatgtcaattgcattttcaacgatgacactcatccgtgttagatgacgaagtgtcttttcccatgccgtttcaagcacttcaaaggatttcatatctttgaagtgaccaaaggctggtgcaaaccgtttgcctgatgcaggatcgataccatcattcatggtaatcaataaaactttcgggaagttcatatagctcatacctgtacaacggtatccccatttaccaggaacagccgtttctacacagccaatcgcactgtagtcataggcatcttcttccaagacacctttctcgataaaggagggaatgataatttcatcgttgttaaaggcaggcataccaaaaccaagtttcatgacttcaatacattcattcatgaagcgagcatctaggcctgcatgatagcgaacagtcaagtttggctgtggcaggtgtgtttgggcaacagatttcaatactaagtaagaaagtggattgacagcatccttcttatcacgtgtttgtccaccaatggttacattttggtatagtggactaccagcagatgagaaggtatgtgattgactacgaaccttgttgatagtaatggtcttaatccacaagttagttaagcgttcgacgatgctgtcttccgtttcacgtcctgcttctaaatcagctttcacatacggatacatgtattggtcgaaacgtccataggatagagaatgtccattggactcgatttgcaagatacactggataaaccagaccgattgcactgcctctgcaaatgtttcagcaggttcatacggcaccttcgcacaaatccgtgcaatctccagtagttcttgacggcgttgagctgttggtgctttctctgccaattcagtagccaaggcgacaaaacgatctgcgtatgctttcaccgcatcaatgatgataaagattgagtcatagaaatgatatttatcaatacttgcaggatccgtcaaatcgagattagcctttgctacacgaactcgctcctcaaaaccacgcaaaccttgttccaataccttttggtaattgacagccaagtgggcatcgccagagttcatcttaccttccataccaaagaagccagtttccatataaacttgaacttcttctggaagcaagacacctgcacgtgaacgaagattattcttttcccagaatggagcgatgctgcgcaactgctctttagtttcctcggtaatatagaagacatccccatcccgtttttcgaataaatccaattcattcaatacaaactccaaggtatattctgggaagatgggagcatctttatttgaagaagcttggttacctgcaatcagactttcttcttcaatataaagcgtcatgttctccaatatttccttgagcatataggccctttttaatacattgggcttctctctatgttcttgataggcttttgttgctaaaacagcccgttccgcgtcaatatagggcttcttatcaaggacatcttctctgtatttgttcatccgatcagtcagacttccaaaatactcagttttaatgctagtgccagctacttcagtcactgttttcatagttttaccctttctttcgaaacttaattttgtttcgtttgtaaattaagtatatcctgtaataggggttattgtcaattgatgctagtgagcgctaagatttccgaagccggctgcacatttgtgcaactcttttgtctgacatcattgactaaactggttctttcgtttcactttcataggcaatcttatcttggattttgaagaatgggaaataaacaatagttgagacagctaaaataatgatttgaacaactgcaccttgccaaccacccaccataaaaccagaaatgattgctggggtagaccatggtagggtcacacctgaaaatggttgcataaagcctattgagattgcaccgtagacaatgaaagccgctaagatcggtaccaaaacaaatggtaagaacattacaggattcatcacaattggaaaaccaaagacgactggttcatttacgttaaagagtgcaggaaaggccgctaccttaccaagagccttatattgttttgatttagcggcaaatagcattgcaaaaacaataccgaaggtaatacctgaacctgacataatcaagaaactatctaagaattgttgggtcacgatgtgggcgccattttccagagacaatttatctgctgctaaaagggccttattggcatcgaggtttgacaatagtaaagcagtaacgacaccattgacaactgactggccatgtacaccaaaccaccagaggaaggaaatgaagaaagcaattccaatcgcacctggtaatgaaccagtcaaaccttgtagtggcacttgaatcacatcgtaaatcatttcaatgaatgtaccaccgtttgtcgccatcttggaaacaatatagacaatcatagatagcaaaaagatgacaaaagctggaatcatagcttcaaactgcttggcaatagcttgcggtacttgttcaggcatcttgataacaatatgacgctgaataaaagtcgtatagatagcgcccactaccaaaccaataataatcgcaccgataattccttgaccaccaaaccatacttttgcgatggcatcaccgattggttctccatcaactggaatataagatgatttcaagaggataaagaatgaagacaaggacagtacacccgcagggagaggctcaactccactatttttggcataagaatagccgatcgcaaaacaagaaatcaagcccataatcgcaaaggttccgctatagacttgcataaacggttcagtccattccgctccaaatatagaagctattgcggcatttaagccttcaaaaggcaactgccccaaaattaagaaaatactaccaactactgttaaaggtaagatagccaacataccatcttttagagcgatgatccctttcatattcacaaatttcatgattgggacaataattttttgtgtatcaattttggacatgaccatactcctttatgaaaccatgctgagtgccaattgaagaacttttttcccgtccaacatcccgtagtctgccattggaatcacggcaatagggacttgcttttcatcacagagcgcttttgacttatcaagcgtatatgctacttgtggtcccagtaaagctacatcgatttcgtcaaggtaatctgcaagtttcccttgggaatgcgcgtcgatttctacttcgacacctgcgtctgctgctgcaatcttcatgttgtttaccaacatgcctgtagaaaaaccagcggcacaaaatagagcgattttaaccatttcggtttcctcctaaatataatttttttgttttagccaactttttttagttctttccgcaaatcaatgatttctttaatcaaattgatctctgtaatagacgtcatcaaatgatcttgcgaatggacaaatagtgctgtaatatcagattttgctccaccagcttcctgtgctaagaattttgtctgcatattgtgagcttctaataatgctgcatctgccaattctaattcctcttctgctcgctcttcttcacctgctttgacaagcgacaaagcttggtaggcgtgacttttcgcatctccagcataaataatcaatcccatgatcaattgatctgcaacaatcatttccatttctttttcctccgatttgttttatttgtaagttattatatttctttcgtaagtaaatcatatcattttctctttatagcgtaaatatatttatagaacattttctgttttaatttatttctgcacttttgtgcattttttgggataaaaaatacttcaaccacctttaagtgattgaagtactctcttacaaatttgtatggacatgcacatcattatccagttctaaaacttttacgatggttcgttcatctgttaccagatgatgaatgtagccagctcgcaatacagctaaaatggcttgagccttttcctccccatatgcaagagctattgtatctgggacttcttttaaatcatctaaagagatggcaatggtcctcttttgcaaatcctccacgacagcttgaccgtattgattcagaccacgacagcaggtttcaccgactgcaccttcatctgacaaggcttgaaaatcagccgtcgtcaacatatctaaccattgacgatttttttcatcgactcgaccgccaatacctattgctgctacatctaagtccttccagtcagcacgtagctcctcgaaatatttagaagaaagaataccttgagcaagttcttgattctcctggataatcgtcgcattgataaaactacattctccacgaaatttattggccatatcgtaaatcagagtattcacatgataacgtgcgtggatatgacttggaccgccagctattggaacaaatttgacacctttcatacgatgattccctatcttatctacaataagactgaggcttctcccccatgaaaaaccaactttctttccatcatcaattagattggtaagcatatcggctgcagcctgtgccagacgattttctaaatcaagctggtcctcatcggtgctgttttcaaccagttctaaaccttttaatccatatttttcttgaacatatttttctagtcgatataggcgcctatcaaaatcttgaatttctatttttacaatgccttctgacttagccttggtcaacattctactgactgtcgttctataaattcctgtatcagcagcaatctcagcttggcttttcccctcttcgtagtaaagataggctatttttgccaactgccttcttttttcttgcttcatactgcccccgccttactgtgactctagcattttctaattccttgacaagatcttcagaaatcgacgtatctgtaatgacctgagcaacttgacttaaaccaaatctgcgtactgtccctcgttttgtaaatttactagaatctgttagcacaatcatgttttcagcaacgtcagacatgtactgtactacttcgcttcgcattaagtttttacctgtaaaaccatgctcactatcatagccgtcagttcctacaaaagccttatcaacatggaaaaactgaatcattttatgcaagagcggcccaacagttacttgggaatctttttgaaactcaccacccaataaaataatctgacagctatcatattgtcgcacataattggctataaaataagaatttgttatgatggtcacatttctcttggttttgcaaatttcttctgccaagagagcacaagttgacccagactctatcataatcgtttcattgtcggcaatgagatttgctgcttcttttgcaattcgtttttttacatcatagcgaaaggacatccgaatattaaggtcatcaccactatttagaacagcatacccatgttctctacgtaataaaccttttgattctaacttatctaaatctttacggatggttaccttagaaacgtccagttgctccgccaagctattgacatctattttttcatgttgtgataccagttgtataattttatctaatcgttccatttcatcacctcatcattattctatcaaattttgactctttttcaactatttgcaactttttaacttacgttcgtaattgtaaaactttcttttgtgtgataaaatcaaattaatcgaaaaggagaaagagcatgaatacacgaaaaggcattatttttaacattcaacatttttcgctccatgacggtcctggtatacgtacgacggttttcttgaaaggttgccccctacgttgtccttggtgtgcaaatccagaatctcaaaaacgaaaacctgaacccatgcttgatgctgttagtaaaaaaatgaccatcatgggagaagaaaaatctgttgatgacatcatatccgaagtcatgaaagatattgatttttatgaagaatcaggtggtgggctcacgctgtctggcggagaaatttttgcccaatatgagtttgcgaaagctattcttatggaggcaaaaagacacggccttcataccgctattgaaaccaccgctttcgtagaacaccacaaatttgttgaccttatccaatacgttgactttatctatactgatttaaaacattacaatacaatttctcatagaaaagtcaccggcgtcaataataaccttatcatacaaaatatccaatacgccttttccatcgggaaagaaatcgtcctacgtatccctgttatccctgactttaataattccctcgaagatgctgaacaattcgcctgtctctttaatcaactcaagattgacaaagttcaactactccccttccatcaatttggagaaaataagtataagcttctcaatcgaacctatgctatgaccgatgtcaaggctctccatccagaagatttaaaagactatcaagcaatcttcatcaaacataatatcaactgttatttctaactttgagaaatataaaaacttcctcggctgagccaatagcattcctatagaaatcacatactgaaatgggagtgggaaagacatcgactaagtcaaaaaaggttcgtcaacaatttttcgttttaagttgttgagctgaaacagtctatccccagactgtttcactcccacccccgcacagttgattaggttagatttcgagtgtaaaacacgaattgctgagatttgcttcgcaaatcttatctcctacctttaacagtccactggactgttaaacccaatcaaccactgcgctgagatgttgacacgaacactgagaagtgggccagggctttttgcccagcctcacttagtatacaaaaagcccaccataaaggtgggcaagggcatcgtttccgatgagaatagaaggttcacacaactattcaaggtccgctcctgcgtttcaattaaatgaagacctccctagcgtcgaagggagtgggaaagaactcaacttgtcaaccaagagttcgtcttcccacccccgcacagttgattaggtcagatttggagtataaaatacgaacaaatctgccaatcaaccactgcgctgagatgttgacacgaactcttagaagtgtgctgaaccttaatccccccactactcggctcatcgcatgattctattctaccataatctcaaggatttgcaagcctgattactccattcgttcttgaatggttacctgtactctatcaccagcctgttttccaatagccgctcgaatagccttttgaacgccaataatataacagatattgcctgcttcatccttaactcccatattgacaatggagccatcatagggatgacaatcaaatctggcatgtacctttaccctccccttaccaaactcttctcgtatatcatagggaaagatgatataggctccgcccttatccggtactggatggataagggtttcaaattcatagactttggacatggctcctcctagatatacttactggcttcgcgaatggacaagcctgccatttgtgagctgtacttggtaagaaaaactcgtacccattcaggattggtcttggaataatcccgcaaactccagccaattgccttattgataaaaaattcagtctgattgagattattgattaggatttgttccaacagtttcgtatctgtcttttctttttggagaagctggtggtcaatggcaatccgtctcaaccagaaatcattatccaaactccattccaagattgtctgcttggcctctggattttccaagataatcttaccaactagcttatctagaccgtcaatactatcccatcaagacttggtctgagctagctctttcaaacgaggtaaatcagctagaaccaagtctttcttcttggtaactaggtaatcaatagcgatatattgaaattcacggtagggcttagaccagcaagcctctacaaagtcccagtcaatcccctgagccttgaaatctttgaaaaactgcttggcaacttttcggcggtcaggcgttcgtacacctaagaattcaaagttatttttcatataagctttcataggctgggcctgactagcatccgccacggccaacaaacgtttttctaattcgttaatcttcattttgcttacctacaagagatttttgaagccagacaatatcatgccaggtatcaaatttataaccaacttttttgaaatgagccacctgttcatagcccctcttctcatggagtgctatagaggctgcgtttggtagggcgatacaggctaagaaatttttaaaaccacgcgctgtcaggtccttttccaaagcattgtagagaagagttccaattccttttccgcgcgcttcttgcttgatatatacggataattccaccgtccaatcgtaagccgcacgggcatagtaggttgaagcgtaggcataacccacaactttaccttcttctactgcgaccagatagggaaacttctccaaggtcttttcaattcgacttgcaaaggcttcgacagtcggtacttctgtttcaaaggtaatagcggtcttttctacataaggagcataaattgccacaaggtctgccgcatcctctatccttgcggaacgaatgtctatcatttagttctccaataattctctatcataaattgtataatcacagcggtagataatcaaccgcttgccatcaattaagagttcagaagtcttaggtgcatcagatgcataaagagatactttatcacctacataagtagcaagcggggttccgttttgcgaacgaatcaagaccacctttgccttacctgtaaaatcatttttgagactagataccatacggttaacaagcggaattgcacgatcgtaatttgcgatatctactgtggtctgatatttcgcatacaagtcttccaaaccttcttctgccgcaatcaaagatgagcctacgtggtcaatttcgtaattcccaagtgtcaccttcaagacagaagaatccgcattggaatagccttcggcatccaccgagtcaaattcctgattccgcgaaatcgatagggacttaccagacatttcatctatcaactgagaattttcatcataagtccgtaccgtcatctccaagccaatccattcttccttggtatttttccaccaatttgaaatcgactgacaggctgacaaagtaaacaaacttgcgactaagacagcactaagtgctagttttttattccatttcatataaaacctccaatggttgataccttattgtaccacggaattgcctaaacaaagaaaaatgtgtgcaaggtattcaataaacaaactgagatcatatcctttcaatttgaaaacaagcctaatcaataattttattccaaaaacaatttttaaatatgcaagtcaaactaatttgctatttccaaacatttatatcattgtgttttgatgcaattccttaaaaacacaattttattataggtaaatgtactgttttgacaagttttaaaaaattttttaaataattctatttttttctacttatttacgaataaataagatgaccggaaaaaaagatagtgaggtacacaaatgaaaatccgaatccctttatatgcacaacatctgaatcaagcagaatttacacaattgatcacaagtagtgttgataccttgaaacagtacagttcttccaccaatgaccccatggtaacggacttaatcaaacagcttgaagaatccttacccttactgaaaaaaagtctcaaacaaaaacgtggctcagacatgactagtaacttaaacaaggctctaaagaatcgaaaggctgactactctgccttcgtcaacggactcaaactttttaaaaatactcggacacccgagaaattacaagcctatcaccgactacaagaactcatcaaactatacaaaaatacaaggtctaccaatatgcaagaatcatctgctttgattgattctttgctagcccgactggcgaagccaccctactcagaagatgttagcctacttatgttagatgaagctattgccaatctccgtgaaagccatgaaagtacatatcgtctctatctgaaaagaagtcaggacaccagcactcgcgaaaaaataaacagcttggaagtccgaaaaacagccttcaatctgtacaccctcctttatagtcacttggtcaataaaatcagctatgacccaacagcccctgaaaaagttatcttgcaagtcctaaatgatattcgccaagatttttcagaaagaacgcgacagaaaaatcaaacaggaactaactccgctacaataaacattgtaacaaccttaccgcaaggaaaagagatagaaacgacttagaaaaataccccctagtcaacatgattagggggtattttctgaaagtattgaatgttcttgaactacaatttttcaataatccgcacaccaataactttctctttcaaagttgacggatcaaaatttattttaggataacatctatatctcaatttctttctcatagctgaactaaggtattcagggtagcgaatctgtttttgaacatcgaatttatattcacccaacggaatttcatttgattcaatttgtatttttccagtgttatcatgtgtatttaaaactgtaattgtgcccgaaatttgaatctcttcggaagaaagaaattcttttttatcaaatatttttatatctttctcactaaccttgaagcccctaccgtcactagaattaaatgagatttcatcaatattttcatcaatagaatgaaccaatttggagaaagagggagcaagttttggagataattctcttacatattctggatatagatagttatttattgtaatatctccaacacttgaactgtcacttaccgctacggctattgaaccatcaccgacattctcaatacttaccgatttaccttcttctttggcagaggaaattgtttttataaaatcataaacagttgtgatagctccccaaatagtttgaccatgttcaagtaaaggaagggcatatgaattcattacaattactaaatcagctaagaaagaaccatgttgaaaattgtcaatatatagtgcaaaattaccactttcactctttttgagcctatcttcgcttatcatatgtaaatacgtcttttctgataacttggaaaaactatccaaagattttaacaaatatttaagttcgtaacctttagattcatccattgctttaccagaaattctgatcgtgaccttgcttaattcactcatagcataaacctctattttcgttactcctctaccttcacctgcccattcatcagcattggcaagagccaatcacggagttgggtcagttcttggttttgttttaaattattttcaattacatctaaaagacttctgacttcatttgaaaataccttctgaatttctttatttgggatcacaatgcgaatttctgaaagtgtagtttgagaaatatttttcattatagttcccgcagattgattagacatgagcatttcaatattctttagatgataaaatacataataaaatagattcaaattggcaacagttgcaccaataataaaacctgaataaattgtgttaactggaatatcagagactatcctagtcgccccaggaattccactgcgagttatcagaattgttctatctgtaacaagatagctttcaatacgtcttctatctaaagtaattgagtccaaatcatgagtagtaacaaaagtactagaatttgaaatgttccgtacgtttacaatttttgaaagcgtatcccctgtctcagatttttcataattgattccatttctaaattcacatatctcacccaactgcttcactccccacccttctgggatttcccgtttgagttggtcgttatagaccattttaccaccagaggacttgtagggcttaccattttcatcagggaaatcaaactgcacaaaccaataatcataaagcgtcttggccatagcctccaactcctcgttgatttggttattaattaagatttttttatcaatagttgacaataagttgacaattctatcttgataatctttgttgggaacctttaattttaattttgttaagtagtcgatattaatattatcttggatactaccactagatgtcttctgaatttctttttttattaattcaaaaacataataaacaaacaactcacttgattcatttttatgtgcattaaaaccaacaacactatcaggaaaacacattgggtaagatagaatcgctgtttcagcaatatttgctgctattgtaatacaaagagtcccttgcttccatagcttactttgtgacaaaccaaattcgttataataatcactattctttgttacataaagatttgaatttttaatatcacctgtctggattagcggataggttccattagtaaataattttttatcatttcttggacgatgtttagattttccccttgaaaatcttcccagttcagacaaactctttatttgccatcttacctcactcatacctcacccccctcagctgctccgctatttccttttccaattcatgcgattgggcaaagaggttagctaggcggtcttggtagccctgcattttttcttcaaattcttctgggctaatatcaacgtagtcaatcttgatgtcaaagtactgacctgcactgagggagtagttcttatccttaatctcttcatagctaaccttgacagagaagtcttcgacaacttctttgttaataaaggtctgaatgatttggctttcttcatcagggctaaggactgtcttttggttcttgccttccttgaccttggtgccaagattagaagcgtcaatcaagaccacatcgtccttattcttcttatcgataaagagaatggacacattggtgcctgtggtcgcaaagatattggacggcatggacacaacgcctgccaacatcttttcatcgacaaggtgctgacggattttcttgtcaatacctgactgggcggtgataaagcccgtcggcaagacaatagctgcctgcccgtcttccttcaaactatggataatatgctggataaagagttggtaaatagccatactctcttttttcttgttgggaatctttggcacacctgcaaagaaacgttcactgctatttggcaggctttctacctgatctcgccactcagaaaaatctaatttgaaaggaggattggacacgatatagtccatcttctccacatgacgattgttgagaatggtatttccctgtacgatattgtgaatggaatgctgcaagccattgagaatcaagttgagacgcaagagattggaggatttctgagaaatatcctgactgtaaacgctggtacggtcggtaccaatctgactggccagattcatcaccaatctgactggccagattcatcaagagagtccccgaaccagcagaaggatcatagattttgacattacttggttggtcattgcccaccaaaatggccgcgatgattttggcaacagagtgaggtgtgtagtattccgcatactttccaccaccgtctttgttatagtccttaatcatgtactcaaacaaggtggagaaaaagtcaaagccctgtgaaaaaatctgctgatcaaacttaacacgcgccaagagattgataatagaagctgccacttcatttcgcttgctggcatctgaaatcgtatccgtaatcaagcgttgatcaaagaggcgaatatctgttccaccgtccgtatggacagagaaaatagcattgttgtcaatagcaatctgattgagagtctgttcaaaaatctcagcaaaatctgcttggttctgttgacggtgtaggctttcaatcagctgttcaggttttagatgagcagttttagtcccaatatcatctaaaaaccagtcataatcttcttcagacaagtccaaaagaccttgatagtcataacgattgtcaacgatcaaggcttcatacaaaaacttgtcatttaagaacttgtaaaggaaggactgggtcagaagtttgtactcccccgcttctcctccaagtcctgcatgggtaaagacggcttttaggtcatcaaccaagccttgtacttgactttgcacctgcacgatataatgttcttccatttgtttaatattctccttcatagacttccattagggaacgaatcaacttatcataatcgactcgtttgagttgcttccctacttctgttttcatcatttctttacgggccagttgcctgatctgcgctaccaaataggcttcgttttccagaatgccttgattgagcccgatttgataatcaatcagaggtttggcaccttttagcacctgataaatagctgggaagtcactgacaactgttgattgggtaatgtgcttaaaggcacgggcagacatggtatctccaccaaagttcatggccaagcgattcattcttgttttatagtcttctactgaatcgaataaactttgataggcttgtttggtttctttaatggttgagagactatatccttctacttcctgtgtcatgtgcttgtttaggatgcgttgaaactcttcataaagacttacccattcaggatctttttcatctctccgtagattgataccattggccacacggcgtcggatatcgtccaaatcattggctgccagtcgtagttcctcttcctttatcttggtaaaactaaagctagtctcagacatggctagattcagtagttgctgactagaaaaactatctggtttttctaacaagttcaaagtcaagaggcggcgggacagcatatttaaaaggctagcaatttctcctatattgacctgtttgacaatatcgtggtaaccatgcaaacgtgccatgttgtagtactgacgaatggtttcaagagattttcggagggcgattaactctttcctatccttgacttcatcgatggctcttccgaaaaattctaagttatctgtcggatagttcattagaactcggttagagctcgctagctgttcctggacttcttctggggacacaaaaatagttccaaaaggattatctccgtcttcttctgtcaaagctgcctggtattcccgattgagttcttccagataggctttattggtcttgtcaaattccttggaaatgtccgcaaaatcaatgacatagccaaaagcataatccttgtacggacggttgacacgggttaaggtctgcaagagattatgggccttgattttccgtccaagatagagccgtttcagccttggtgcatcaaaaccagtcaagagcatggagtagacgatgacaaagtctatcagaccgtccttgaatttatccacttcttctttcttgtattccttatccccagcatcatgtaaaatcaaggttgaagtgaatgatgtaagccctgcttttcgacggtcttctaactgtttgtgtaattctcgggcttgttctgaagaatcacagaccaccattccaccgatagactggtcgccaaataagatctctcgtgctcttgtaaaatcatcaagaataaagtctagcattggagagacataacgggggtgggcaaaaatttctttcttttcaatggagcctttttgaatctcttcgtgtacagcttgtagagtttccttgtaagaagtttcaatatcttccctcatcaaccgtagggtaaaaccgtcagcaatggattgattatagtagtatttgtggatatagtccccaaagatatcacgagtcgtcacagctgtttccttggttttaccgtcagcctttgtcgcaatcaaaggcgttcctgtcagtgcaattttaacagcttctttatcagcattatatagatttggcagataggaacctttttcattgtaagaacggtgagcctcatcaatgaagtagatattttgccgattcaagtcatagcctgaatgatctgtcaaatcagaggattctttgaatttttggatgttgacaacagaaacatggtgctggtcttgaatctgatttaactcgcttggtttgttaattcgtttgactttgagaccacgcttgctaaattccttataggcttgatcagccaaatccaatcggtctaccacaaagtaaaactgcgggacaacacctcttttagcataaaagtctcgtaagtatcggatattgaaaaatgctagagcggtttttccagaaccttgtgtatgccaaataacacctttcttcatcccttcttccaatcctcgctcaattgccttggtcgcaaaatattgaggatagcgcatggcgtgtttttgtagttgaatctggtcatgctcatctcgttcttccacatagactagaccatagcggagcatgaaaaagagccgttctttctgataaagggaagttaaaaaggaattgcaaggacttgcaggatccaagttggttcggaattcaacttgcgacttgagggcaaaacgattgacatctgtgagaaccaaatcaatcatctcttctgttaagctagacaggctagactgtacttgtccctcctgctcttccttgaaagagttgaacttggtaccagatgaagcattggtgcagtaataagaaccttgcaactgttgtccttggctatcatcatagggaagattgtctgaaaaagcaatcaactgtgtgatattgttaaaccgtctgaattttttattttcaaagcggagcttggcacgttctttttcagagtgaattcctgtttttccatcacgaatagcatctggttgcttgacttcgatataactgagagggagaccgttgataaaaacggtgatatcaggccggaactcttcctcaccattttgacaggtgacttctaaggctatatggaaggtattctcttccatattatcccaattgatataggtgtagccagaatctgcatgaatccgattaaaaaaacttcgtcctaaatcatcttgttctaattccaggcgaatgttttcaaattcttgttcaaaatcagcttcacttgcgtaattattgaatgttaaaaactgtcgcttaaaaattgatagaaggatattggttgaatggtctctgttttttatgtcttcacttgtagccgaaagatagtcatatccaagccgagtcaaatgcaaagcagctggcaactgaactcttgtaaactcattgtgttcctttcttatcatacaactctcctagtcttttcttatcaatcattataccatatttgcaagtgctgaccgacaaaaaaccgccctattggacggttattacactattaaaaattaaagacatcgttcaaattctcagccatagtcggatgggtgaagatttgtgttttgaagtaggtataaggaatcttattgtcaatcgccatagcaatcaagttaatcagctcctctgaattgcgaccaaagagagtcgcccccagaacaagcttactttccttatccacgataaccttgaaaatgcctttgaggtcattattgacatgggcacgtggcatattggcgacaagcaattcgttggcaatgtagtcgtaacctgcttccttggcttccttctcggtcagaccaacacgagaaagcacaggcgtgataaagacgctggtcggaatagacttacgttggctcaagctataagttccagtcccagtcaacttgccgaaaacgatacggaagtcgtctagggatgtgtaagtgaattgtggaccgccattgacatctcccaccgcatagacacctggaacagtcgtttcgcagtagtcatccaccttaacagcaccattttccaaaagctcaatcgccgtattttccaagcccaagtcagcagtgttcggcacccgacctgtcgcatagaggacagcgtcgaaaattgctgtttcgccattgaccgtcacagcaacttgctcgcccgcagctgcgacttgctcgattttcgcacccaagacaaaggtcatgccagcttcttccatatactccttggctagctgagcgactccttcctcttctcttggtaaaatagcagagctggcttcatataccatcacctggctgccgagtttgctgtaaagtccagcaaattccaatccaatgttaccaccaccgataattgccaacttgttaggacgagtttccaagttctgaatgcctgtactatcataaacgtgagctatatccaacaaacctggaattggaagcacgcgcgacttagcacctgtgttgatgacaatagtttccgcagtcagttgaatcgactcttcaccggccgacacttcaacgactttgtccgcaacaaaacgcgcgtgaccttgataaagattagcaccactgcctttcaagactgcctcgtttttgtttcgcagacgagtggtgactgtttccttttgctccattacctgctcaaaagtccagtttttatctgctgctaccaagagggtcttggttggaatacagccaatattgatacaagtcccgccaaacataacaggattttcctcaaccaaggcaaccttttttccagctgctgacagcttaccagccaaggtcttaccagcctttccaaaaccaatgactactaaatcatattgttccataaaatactcctttattttttcaacattagtctatcaaaaaagaaaatttttggcacaattctgctacggcctattatggagtcctagttgcaggaaaaaacattacaataactgagaaggtttagataaaaaataggtgaataatagacaaaatgtacttatttttgatacaatgtatccgtacactagtttattaatacagaaaggtcaaactatgaaagaaaaatttcaaatgtgtaaaacttatcttccagtcgtcttagcaacgattggatttgtcaacggttgcaaaattatctttggagaattaggtaagccaaatggcatggaagctaaatattctctctttctcctaaccatttccttggtcgctatctacctcattcccctactagtactgacatattccttagctaaacgctataacatctccaaacaagttatagggcttagctggcttttaggcttaacaagtagcatctctttttctgaactgggacatacagctatcggatatttcctgctcgaaattgttaaagctagtaatgatttcctaaatgactggggtgcagctatttcaggtccattggcagaagaaatcggtaaagggctaactgttctacttgtactgcttatttgtagaaaaatgacactaaaaaatgcattggtaagcggagtgattgttggattaggtttccaaatcatggaagacatcacctttgtttttagagacatgttcatgaataaattagacggctttgaaactattcttgaacgcgttggtcaagctggttgggcccattgggttttcacgcttctctttgccattggcttagtagcccttctcacgaaaaatacaggtatgtcaaaagcacagggagtattttggatcggtgcaagctttggaatccattttctctttaattcaccattcaacactggtatcttccagacggtgtttcctatcttgagtatttcccttggcttacttgcctatcgaacggttgagaaactatctgaatagacaaaaaatccgcctttgagcggattttttatattcattcttgttagaacaagccgatagctgtcccgtctgctgccacatccatgttgagagctgcgggagcttttggcaaaccaggcatggtcatgacatctccagtcaaggcaacgataaagcctgcacccaattttggcacaaattcacggactgtaatgtcaaagtctgtcggcgctccaagggcaaactgatcatctgagaagctgtactgggtcttggccatgcagactggcaacttatcccagccattcttagcaaattcagtcagctggttacgagccttcttctcaaagacaacgcctgtaccaccgtagatttgcgtaacaatcttggtcactttctcttctaagctatcctcagacttgtaaagacgttggtagctggctgcttggttatcaatagtagcaacaactgtctcagccaattcaacaccaccatcagcaccatttgcccaaacacttgccaactcgacaggtacaccgattgcggcacagagttctttgagaacagcaatttctgctgcggtgtcggacacaaattcattaatggctacaacagctggaataccatacttacggatattttccacgtggcgcttcaagttagaaaaaccagctttcactgcctctacattttcagcagaaagttctgtcttagctacaccaccatgcattttaagtgcacggagggtggcaacaatgactactgcatccggagccttaggcaagttcggcaccttaatgtcaaggaacttctctgctccaaggtcagcaccaaatcctgcttctgtgacggtatagtccgccaaacgcagagctgttgtggtagcgaggactgagttgcagccgtgggcgatgttagcaaatggaccgccatggacaaaggctggcgtgccatagatggtttggacaaggtttggtttaatagcatccttcaaaataagagtcaaagcaccttccaccgccaaatcacgcacgtagacaggactgcaatcgaaacgataaccgataacaatatttgccaaacgttctttcaagtcattgatgtctgtcgccaagcataaaatcgccatgatttcagaagctacggtaatatcgaatccatcttcacgaggaataccattgagcggaccacccaagccaactgttaccttacgaagggcacgatcgttgaggtccacaacacgtttccagataatacgacgttgatcaatgccaatcacattcccctgatggatatggttatcaatcaaggctgaaagggcgttgtttgctgtggtaatggcatgcatgtcgcctgtaaaatgcaaattgatgtcttccataggtaagacctgagcatagccaccacctgcagctccacctttgatccccatgacaggtcccaaagaaggctcacggagggcaatcatggttttcttgccaattttagacaaggcatctgccaaaccgatagtaatagttgatttaccttcaccagctggcgttgggttgatagctgtcaccaagatcaatttccctggcgcattgtctttcaccgcattgattttatcaaaagacaattttgccttgtattttccatatagttcaatatcatcaaaactgataccaactttttcaacgatctctgtgataggtttcaaggttatactttgtgcaatgtcaatatctgttttcatgagagtacctaatttccttattttttatggatattataccatactacaacttattttcacatatttttttactatttattcactaacgtacggaattttcagaaaaactacaggtttccttacttaaacagatacaaatttttaaaaactgcattctcatcatagctctacacttccatctaaggctggttttagttagttttttcaaaagagagtcagtattcctttaaaaattgccttgattaacaaaccaacgctttcttgcacaaaaacacttcactatataatacaggcccttatattttttgtattagcagcatcattttccagtgtcacagattgattagcaaatagattagtacaaactttacgaaaaatagaaattctagtaaaatatgaacatgaaactattgattacatcaggcggaacaagcgaagctatcgatcaagtccgcgctattacaaaccatgcttctggaaatcttggaaaaatcattgccgaacaagccttgaaacgcggtcatgaagttactcttgtgactacaagacaggctgttaaaccagattctcagaagaatttaaccattatcgaaatcacaaatgttgatagtttgaaagaaacattagaacctttagtcaaaacacatcaggctctgattcatagcatggctgtatccgattatacacctgtttatatggctggtttagatgaactaagagcaactgaagacatttctagtctactaaaaaaacagaatacagaaagtaagatttcatccaaggatgactaccaagttcttttcttgaaaaaaactcccaaggtcatttcctatgtaaaaaaatggaatccagctatcacactctttggcttcaaactattggttaatgttcctaaggaggaattatttgccgtagctcgccaaagcattgaacgaaatggcgctgattatatacttgctaatgacttgaaggatattggagaaaatcaacacattgcctatttggttgataaaacaagggagattcaagcacagacaaaagatgaaattgctcagctcattttaaataccctagaaaaaggagaacaaaatggctaatatcacacttgccgttactggctctatttcagcctacaaagcagcggacctaactagtcaattgaccaagatcggtcatcaggttacagtcctcatgagtcgctctgctatggacttcatcacacctttgactctccaatccttgtcaaaaaatctggtccacacagatgtcatgattgaagaaaatcctactcttatcaagcatatcgatattgccaaagaaacagacgtatttttagttgcccctgcttctgccaatacgatagctaaattagctaatggtatggctgacaacattattacggcaacagcgctggctctgccaattggtactaaaaaactgctggcacctgctatgaatactaacatgtacctcaatcctgctacccagaaaaatatcaaaaccctcatagagtatggttttgaggaaatcaaaccgcgtgaagccctgcttgcttgtgaagattttggaactggggccttggctgaggtaactgatattttagagaaagtgagtaacacccttgatgaaaaaaaataaatcaactcaaattgctacaattgcaatcttctttgctgtcatgattgtcatcaatatattgagttcaattatttttaatatattgcctgttccaataaaacccaccatcgtacatatcccagtcattattgcttctattatatacgggccacgtgttggggcttgtttgggggctctcatgggcttaatgagtatgacccataatactattatcttactaccaaccagctatcttttctccccatttgttgaaaatggtaatgtttattcaatcatcattgcagttgtcccacgtatattagtcgggattacaccttatttcgtctacaaatggataaaaaatcgtaaaggattatttattgctggtgcaattggttcaatgaccaatactatttttgtacttggaggtattttcttcctcttctcctctgtctttgatggtaatattcaagcaatgttagcaaccgttttaggtaccaattcaattgcagaaatgatcatttcttctgtattaactgcagcgcttgttccaactttacagaaaattcaaaaataaatatcagaaaatcatgtgaaagcgtgatttttcttttcaaacatggtataatgaaagcgtttaatagaaaaatttttaaggagatatgcgatgacttatcaagaaacctatcaaacatggctcgactttgcggaccttccagattacttgcgtgaagaattagtcgcaatggatgaaaaaacaaaagaagatgccttctatacaaatcttgaatttggtacagctggtatgcgtggctatattggcgctggtaccaaccgcatcaacgtatttgtagtccgtcaagctactgaaggtttggcaaaattggtagaatcaaaaggtgaagaagctaaaaaacgtggtgttgccatcgcttacgattcacgtcacttctcgccagaatttgcttttgaatcagctcaagttttggcagcgcatggtatcaaatcttatgtatttgaaagccttcgtccaactcctgagttgtcattcgctgtgcgccattacaatgccatcgcagggattatggtgactgcaagccacaacccgaaagaattcaacggctacaaggtttacggtgaagacggcggacaaatgccacctgctgatgcagatgcattgaccaactttatccgtgccatcgacaatccatttgcagttgaattggctgaccttgaagccagcaaggaaaatggtttgattacggttcttggcgaagaaactgacgttaaatatcttgaagaactcaatgacctcaacatcaaccctgaattgattgctgaatacggtaaagacatgaagattgtctatacaccgcttcatggtacgggtgaaatgttggcgcgtcgtgcccttgcacaggctggttttgaatctgtccaagttgttgaagcacaagcaactgctgatcctgacttctctactgtcgcttcaccaaacccagagagccaagcagcctttgcccttgcagaagaactcggccgtgaagtcggggcagatgtccttcttgcaactgaccctgacgctgaccgtgttggtgttgaagttcgtcaagctgacggttcttactggaacctgtctggtaaccaaatcggcgctatcattgctaagtacatccttgaagcccacaagcaagcaggtacacttcctgcaaacgctgcccttgctaagtcaatcgtatctactgagttggtaactaagattgctgaaagctatggcgctaccatgttcaacgtcttgactggtttcaaattcatcgctgagaaaatccaagagttcgaagaaaaacacaaccatacttacatgtttggtttcgaagaaagctttggctatttgattaaaccatttgtacgtgacaaggatgctatccaggctgtgcttatggttgctgaaattgctgcctactaccgttcacgtggcatgaccttagctgacggtatcgatgaaatcttcaaagaatacggctactttgctgagaaaacaatctctgttaccctttctggtaaggatggtgcagaacaaatcaaggcaatcatggctaagttccgtgataactcaccagcacaattcaacgctactgacatcgcggtctttgaagactttgcccttcaaactaagacagacaaagatggaaacattgaaaaactcactactcctccatcagatgtcttgaaatacaccttggcagatgattcttggttcgctgttcgtccttcgggaacagaaccaaaaatcaaattctacatcgcaaccgttggtgaaacacttgctgaagcagaagaaaaaatctccaacatcgaaaaagaaatcaacgaatttgttgggtaagagtcacataaattagaaagttcaaaccacccgtcaaacgggtggtttgaacaagggctataagcccacatcaccagccagcgcctaaagacgctggctttcactttgttcaagcctcactgcttttgactcgtcactagcctcttaaagaggcattcgtactacttgccattatccctaaagggatcttcatactcttttacactcaatttatcaagtgctatatcatgtttaactcgctttttaagctgaagctcgtgaagaaatcatccactggataatttctttattcttgtatatatttcttaattgtggcttcattaagtccaaccgtacttacataatatccctctgcccagaaatgacgattaccaaatttgtatttgagattggcgtgtttatcaaacatcattagagcactcttaccttttaaatatcccataaagcttgatacacttaatcgcggaggaatactgactaacatatgaacatgatccggcatcagatgtccttcgataatttctacgcctttataactacacaaacgccggaatatttctcccaaactacttcgatattgattatagatgatttttcgtctatacttaggtgtgaagacaatgtggtagaacacagccactttgtatgtgataaattatgtgccttttgtgccatacttttctcctctcgctttacaataggcttgaatacctttattgtatcgcgtttggagttttttatgtatgagcggctagtttttgcccagcctctttcaggggacaacaaaagccttgactatggcaacaatgcccaccagataacaaatcgcaaatgtaaaaaacagaaacgcacccataaatattctccttcagtggcgagaaggattgctcagcaacctatcctctcacgatttctaataatttttcataggaatcaaccacatcataaatccgatcatccgcaatcaatcctttttcttttagggctttgaagtgggcctttgcacactcaatctttgccaactccgcccctttcagttgcaaactagacatggaacctttggtttcagctacgaagtaaacatgcttgaccgaaccatctcggaaggcaatggcccagtctggattgtaatcacccagcggtgtggaaatcttaaacttgctaggcaatttggcatagaccatgacatcgtcgaatcgctccaagtcctctttgaacttcctctccgttccagaatcaaccttcacataattataaacacccttctcagacttgagcatatttgcatctgacaccttaccactcaaaggattgtccgtaaaaatagaactatcaaaagtttcctctaggatattgtagcggatatgctcaatcacctgactcgccttttgctcattgatgagcctactaacttgttggataaatgcctcagggttataggaaaacatatcaaacttgcttggcgaaatctgcttcaaaatattggcgactgttttccgtttcaactccgtgcgactggcaatttcacccagcaaatcatagcggagttgaatagaagacttatccagcacagactgacgcttgccgttcttatttaccttgaaatccaaaccgtgtttcgcctgcatttcccttgcttcagcctctgtaatcatgtaactaggctttttaacaaacaaggactcattcaaggccttaacagacttttcaatcaactcctcatcatcaaattcgacatagtaggtggacttgtgatgaatactttcccacaaacgtttaaactcttgacgattgtagttatcagggttgatttctcttgcaaaaaccacttccgaatcattttcacgttcaatctggtagcgattggcatcgtaaatcgtttctagaatatcttttacagccacttcatagcctgccagattttcagatagagtaaactgacttgtttctttttgttcaaaataagtagcggtcagattccccttgctgtcaatataatcttgcttaatcaactggcgttcaatctctttagccacttccttggtgacagtcagtttttgaccagcttcattttccaagaccttgttgacaaaaaaatccacttccaccttgcttggtcgatcagccaagatttccctgagttctctttgcaagttcttagcaaaatcttcatagctttcattggcgatgacggtcaacttgttaatattatgaacatcagctcctaaaagctcctcatcctgacgaacacctttttggtcgacggctagacgcatcccacgaccaatcttttgtcgtttttctgtttctgtacctgtatttttcaaggtacaaatctggaagacattaggattgtcccagccttctttgagggctgagtgagaaaagataaagcgaataggttcctcaaaagacagcagacgttccttgtccttcattatcaaatcataggcatccttgtcgttagactggttatttttcttttccgtagcagacttgtagtccacaaacttgaccttatccgatttttttatcttatcgacagagaaataacctgcatgaacaggattgccttcttggtgcttgttgagataatgccaaaagttacttccatgaaggttgagatcagccaataaagccttgacctgggcttcatactcttcttcaaacatctgggcataggtgctattgtaggcatcattttgctcatcatagcacttatacttggcaacttcatcgatgaagaaaagggatagcaccttgatacctcgtttgtaaaggcgttcttctttttgcaggtgactggcaatggtttcccgaatctggatacgacggatgtcatcttcgttggtttccccaatcacttcgcccacatagagtttgcgattggcaccgatttgaatggaattttcaccttcacgcgcatcaaaatggctcaaggtccaaccgccttgataggctggtaggttgcctgactcttcaaaaagagcaaaaggctcttcaaccaatttggtcacccatttgacatcgcctgacttggtccgcacttcaaactcaatccgagccttaggagaacctgatttttgcggaaccagttcttgcagataaaggtagccttgtgttcctgtggttgcagtctgctccacggtcttaacggcaatcttcttgaccaactttttattgtaggcgtccagggcatccagacgataaatcatatcgtgcttgtccttatgagtggctgaatagcggagagtaaataggggcttgaagtcctccaagcgttctttagtctttttcccctcaaccgactgaggctcatcgataatcaaaataggattggtcgccgcaatgacatcaatcggctttctccagcggaaactttcctgctcggtgtgaatacgacgggcatctgctccagtggcattaaaggcttgtgagttgataatcataacctgaatgtccgaggagttggcaaacttgtccagctcgcccaaacggctagaatcatagacaaaatagcgtggcttcttgccatactccatctggaaatggtccgccatgatttcaaaggacttgagcactccctcacgaatagcaatgctcggcaccacgatgataaacttgagccaaccatactgcttattgagctccatcaaggtacggatataggtgtaggtcttccctgtccccgtctccatctcaatagtcaaattgtaagacggacgaccatccactttttgaatagacaagttttcagatggtttaaggccatagctgagctgcttagctcgaacctgctggctgacagtttcctgcgaaagctgaatgggagcattgcggaaaccgataaaattcatgtccagttccgcacccattccctgacctttatccatgtggtaatcaaaaccgctatgtttgccctgaccaacaaaaacatccacaacagaggccaccgcatctaactgaaattgctgctgcttaaattgaagtttcatctcctacaccaccttcactttggtatttggtgcttcttctttgaagatttggcccaggttgattttggctgcggagttggcaaaggattcgtccttaaaaacagcacgaaggggctctgctttggcgatttgacagaggacgctttctgaaatctcatccgcaaagcaggcaatcaaggcaccatctgctacattataaatggctgtaccgtcaatctgggttttcgtaatcggaagagataattccatgccccatgtcagcataatctggaagagcaggtcaaggtctgtccgaccgtctttgatgttggaaacactgtcaaataggctttcttggctaaagctgtttggtgtttggctaacatccttgaagtttgaagtgtctagcttataagccctgaagccaaaatcttgcttgccgactgtttctgggtgttcttcttgaatctttttagcagcccgacggatccgctcacgagaaatctggtcaatggtttcatagccagcctccttggcagcggacttgtctgccacctgctcgtccagcgtacagagtatgtacttacgattaccgccatcttctgcattcaactgcataacagcatcagcagtggttgcagaaccagcgaagaagtcgaggatcaggccgtctttttctgaatacaattgaacaatttgcttcatcaacggaactggttttggataggtgaaatatgccttaccatcaaataattttttcaagtcttggctagcagactgagaatgaccgacatcagcgtacttccaaatcgtcattggagttactgtattttttacttctgataaaaatctttttatcctaggcacattatctccattagccccgaaccaaatacgattatcagcaataaattcttcaaatctttctttactcagcaaccaacttctcccgcttggaggaaaaatagatcttccgcttggagaaattatctcataaatatttgaaggaactgctggtcctactgataaatcaccacttgtccaaggtcctctaacatcattatcaggattttggtatctactatttgagtcttcgcttctaggtattccatgattgacagcaaattctacattttttgcatatactaaaatataatcatgactttctgaaaaatgttttttcaagtttacaggtgcaaatgctctctcccagatgacatcagcaacaaaattctcctccccaaatatctcatcacagatagctttgaggttggcttgttcgttatcgtcaatggagattaaagataactccactatctttgaggaggttgcgggcaaggactaggcgagagtacatcatattgagccagtcggaatgatagcgggcggaggatttttcattcttggtcaagcccacccgttgcaaaccgtcctcatcacgcagatccatttcatctgccagttcttcctcgctcatctggaatttatccgaatagacaaagtcctttcctgtattgtaaggtgggtcaatgtaaatcatatcaatcttgcccagataagactcctgcaagaccttgaggacttccaggttgtcccctgttataaagacattttcagacttgtcaaagtcaacactttcctcaagatctgggcgaagggtcttggtggtcggtttacctgccattttcatcactactttctgttagaacctcaggaaaaagctgaccaatttttgcaatgttgtctgataaaacatcttttgaccttaggtctagcttttcaacttgagtgtagtctccaagcttctgctctgctctgctctgctctgctctgctctgctctgctctgctctgctctgctctgctctgctctgctctgctctgctctgctctgctctgctctgctctgctctgctctgctctgctctgctcatggtattctccttttcttaggctgtcaagccgtttttgatgatgtagataaaaaattgtcaaacgattttggtttgtggtataatagttttggaaaagggattgagcgccaactcaatcccagtatcgttttcttccgttttcgagaaacgacctcaaacagtctcccagactgtttgaacattttaaagacgggacaaatgaagattacagtcaacctgctagttcactcggtcaaagtttcgtagcggttggctgtcttttattttttacgattgttaaaaataaatgtcagtagcacgattagcaacgtgctaaactgaaacatcagcccgaaggcttctgcgacagacattagttagagtaaaatcaatagagatgctgattgtctctggcatcgacatgagatttttgaaacaatatttttcaaaaatcgaattagtgcaacttttagggagtgggaaagaactcaacttgtcaaaaagagttcgtcaacaatttttcgttttaagttgttgagctgaaacagtctattcccagactgtttcactcccaccccccgcacagctcaaactgtctgggagacagtttgaggttggagatgaagcgaactctgttcgcatcagtcgtaatggtcagatttggagtgtgaaacacgaactgctgtgatttgctttgcaaatcctatctccaacctttaacagtccactggactgttaaacccaaacaaccactgcgctgagatgttgacacgaactctgagaagtggctttggactttttgcccagcctcgttttttgatgagaaagttttactttccatcaaaaatgaagttgccacctcccaaaatagatttccgctccacttttggaacttttctactgttctattctaccatattttccacaggttttactgtggatttttttgaacctgtattcacttgtgaagtacttttatctaagagatggtatatcacctttagtaatggtttcctaccccctcacccttctctccatctcctccatatcatagtccaaaaggaggtcatggcagtctgtaaagagctccaaacgtttgtcatcagctaaaacagcaatatcaactccccgattatcgtagcaatgatagatgatattgtcctgactagataggaagagaacggaacttgatagatagttaaaacctccatggtcggctttgacaatctccctcaacaaagcgtttaggtcctggtcggtaactggaaagagatagcgctcaaagactagcacatctcccgtccaatcctccacttctatcaactcagactcagggaccttgttgaagttaaatttcgatgaaaaatgccagaggtaggtgtctatatccctatcttcctgtcgaaggagcgaaaggagcacatagtcgtattctgaactagcctgctcaaaaagttctactgcacgtgcataggctctttcaagatagattgctcttgataattcttctgcttcgtctgcaggcccgatttcaaatctaagagcaagaggtgtgccataaaagaatgggcccactagtcgattatctttcagttgaaaggacttcagccattgactcaattccatatactattctccttatatagctttgtactattctaccatatactaggaaattaggtctagtcttcttttgaaaaatatgatagaatagtgaactagtaaagtatctagtaaaaggaggtcctatgaaaaccgaatttatcaatgagaaggctcaatcagctttcaatctcaacatcgtcacctctcctattgtagctattattttgttgctagtaggagattcactaggagctgttattttcactccaataagctttttactcccatttagcgagaccctttctgtaagttttgaactgttcgctttcgcttttatcagcctgatggtcattttatgggcacggtatattgaaaaaagcccgtgggtaggacttggttttactaaaaaaggtgcaggaaaagattttctactcgggtggggaatcggagctgcaatgctgaccacttgtacactcatcatgtggggattaggcgcgattgaatttacaagcatccagttctctacaaaattagtcggagaatttattatccttatccttgcctggtctatccaaggtacgacagaagaaattctaacaagaggatggatgttctcatcactttctgctagacataatattcctatcggtatcattgtttcttccctcttcttcacatttctccacctcggaaacaatgctatttcactcattccaattttggatttaactctatttgccgttcttgcctgcctcattatgctcaaaacaggcaacatttgggtgattggtggcttacacgctgcgtggaactgtttccaagggaatgtttttgctttctcagtcagcggcaccgatgctggtcaggcctttattcaaatcggtatcactggtcctgagtggctatctggtggaaagtttggcgtagagggctccgtcatcagcttgcttgtccaaggtataatgatttgctggttggtttacgatctctatttcaagcccaaaacaagctccctataatcataaaagactgttagctactctacagctgacagtctttgttttttcaatttttcgtagaaaatagtcctggataaatgatagtaaggagtcacaaaaaaagataacagatgaagggtcaataattccccaataaaccaacctaaaaaggataaatctaaccaaatacgttgccaatagttccctttcatcaagaaacgactttccctaaatacagccaggggaccagtataactagcattatccaaatggtcatacaagacgaaaacaaccagtgagtaggtatagtagacaaaaaggtaaataatcattcctagcaggaaaatcggagcccctatcttcattaattgactaggctgatgaactgccagctctgccattgcccccggagataagaccatcaaactactcattgtgaagcctttaataaataaagtagcccctagattagctggaagtccagctataaaaagaagcaaataataataaagaaaagtggtacagataggcttcttccattctgtctttaaaaatgaaaaactatcttttaaagaaaactcctgtctatcccctctcaacaattccaataaatgaaaacaggacagaccgatgaacagctgtaacaacagagcgaagcctaactcacctaaataggtcaacctgattgaagataccaatcgcccctccacaaaagcactgttttgacggagctctagaaatgttggtaggcgaaaaattgttgctggtatagcataaacaatagatagcaaaatggagggaaaaaatagtagtgttgtacctcttgtccgctcgcgagtcatcatcgctcttgatactatatcactcgtcatcatcacaattcccctccaattttctctccttatttataaagtcacgtcgcaaatattatatctacatcggactactttaccatcctactattagtataaaactttatccattaattttccagaacatctcttaaaaacaggaaaatccctccaaaatacgaagggattcctaataatttgttatctccatactccctaggctactatggaagagataactgatttatatgttgaaaacaccaatggattcttggccttcaaatcttcataaaatatagtctgacaagtccaatagtatggatatacgtaaagtcccaaaaacccaaacgtcaaaagaactccaataaaccagccaacaaaagataaatccaagaggaaacggcgccatttattccccttcatcaactgccagctctaactgaagagtttaaatggtgaagaataggtattgttttccaaataatcatagagaagaaaagtgacctgactgagcccatatcctacgaataaactacaaataatccctacacataccagtattaatcctgtttgaaaataagacgaactgaaaaaagctgaaaaatcaggctgataatcaataggagcaccaaagatgacaatagtactatagaaagctaaacctatcaatatcattccaaaaacagcagggaaacttgctaaatacaagaccagcattttcaataatgtcgtactaaaaactggtaaaaaattctccccatctagtaaagtgaaacactccgtaaagctaaccttggttctttgctttctcaccagtcttattagttgaaaacaagctgttacaattaaacattgtgcaataaaatcaaatatgattgacgggccaacagaaataaaatgatgagtccaagtaacaccgtctttcacaatagttgtgccccaggagaaagtaccagtttgcccccagatttgtttcaagccaaattctgccactcctgacagaaaagaaatcaaaacaggtgccaaaaacaaggttatcatcctatctgtttgttcacgaataaccgttgctttagctcgaatatcgctattagacattgcttttctcctttgatatatttgtatcatttatatatattatactattttatttttaagttttccattatttctataaaaaaattgtacaaaaaatcccttcaaataaaagaagggaaatctattattttgcttccgaatgacgatagccataacagaagtaaatcaaaattccaataaccaaggatactccgaatactaaccaagtatctaaactatactggaacataaatgaaagacaaatgataatcgagaggataggtaacaagggaacaagaggtgttttaaattgtccatcttttggcaaaccttcgacttgacgcagacgaataatacccaacgccagcatgatcaaataagctaaggtacagatattgaggaaggaagcaatacttgctagtggaaaaatacctgcacaaatggctgcaaaaatccccacaagaatggtcgcattcttaggaaccttgcttgtttgtgtcaatcggctcaatgatttcggtagcaaaccatcacgactgatggaatagaccattctcgacaaggcgtaggtcatcgaaatacatactgtaatcaatgttagtattgctacaatagaaatataactcgctgcccaatccaatccaacttctcgaagtgcaaaagctaccgcatctgccacattcaacttagtatagtgaaccataccagtcaatactaatgtcactacaatataaagaattgttacaatggatagagacaacacgattccctttggtacattcttctcaggttttttcacctcatcaattgctaatgaaatagactcaaatcccaggaaggcaaagaacatgagagacgctcctgccataattcctgcttgtccaccataaatggcaccaaaaccaaaaggagagaagttcgaccagttttctggtttgataaagaataaccctactaaaataaataaagccaacgctgaaaatttcaaaactaccaaggctgaattgaaacgaagagctgccttagaattaagcaagaccactcctaccacaaaaatcaagacgagaactggtaagaggtctacataggtacctgcagcggggttaaaagttccattcagagctgtcggcatagcgataccaaaattagccaggagtcctttcaaataagctccccaaccagatgcaacactcgatacagcagtcaagaattccatgattgtcagccagccagcaatccaggcaggaaattcaccaaaaaccgagtagagataaccataggcaccaccgttagtcggtatacgcgaggcaaattctgcgtaaaacaaggctgttagtccgactgaaattgctgcaataacaattgagatgatcagagctggccctgcatactgggctgctgccaaaccagttaccgtaaagatacctgttccaaccatcgaaccgatacctaaaaatatcaaatcaactaagcctaaatgccgacgcatttgactatggcgaccgactgcttgtttttttctaaataaactcacaaaatactccttcagaataagaatatggatactcgacagaataatctacggattcctgtcaaagaaccacaacactccattataccataagttgaaatatttcgcatgggtgacgacaagcaaaagagcaaggcttttctacctcactctttcttatgattattctggattaaccttaaagtttttaagataatttttcttatctaactgaccgctaaagtgatctcctactttgataaatggtaatcgatctgtactatcttccgttgctttgactttgtaaatcttgccctcagactcaatatagtagattgtcgcaccgccaattatttgactcgctaaagcttctacttttccactgataacctcagtctgttcaccaacttctccattttcagtcaccgtcaatcctgaaaggctagaagcatccgttcctgtgacttgagaaattaagagcgcaatatcgttgttaacagtaacctgttgataatcttcggcatcaacaagagcgtatgatttaaccaagccggcatcatctttcaaggatactaaatagtaggctgtatctgccaacttaactaggcttggattagtggctttatagcctttttcctgcacttcaccttctgcagacttctgcgctgctgtttcagtcgccgaagccaatttgtagttggtaatttcacgagttctcatattgacaagaataaatccaaggttggatgaatcagcagttgctgaggtgatacctgtgtagagataaatatctgagccgatagaaatataattatagctgtctgttgtatttttcacaccagtttgactgaaaatggtattccagaaaccattttgataagtatagtggtcatctacacggctgataacattgtttgccgaataaacacggtctacccactctggaatatcttccagaccatacttcttactttcgcctgttactgcatccaatacaatagcaccaatcggatcatttgatgaaagtccaaattttggctcgtaaatcgttgcaatataatatggatttccttggtcatccacttcgaaggatggtttcccaaaaatagttgtcgggtattgcaggcgaagatgacgtaaggtatcattcagcaaaaattcggaatctgaatagtgcatggctttgctcaacttggcaagttctgccttccctgttgtctgattaaccttcacgtagtaaccaatcccatcttgatggttgctcagccatttccaaaaattcttatattccaaaggcgatacacggaacggttgctgaccgatagtaatctggcgataatcatccgaaatgccaaactgggagaccttgtcaatggtacctagataagtatcaccgattttttcggctgaggcgcgatctaggagggccaatttggatatgtctgtttcaggaaaatctgctttaaaatccgcatccttgacgcttatgacagcagcgtaatccttagcacgaaatacacgtgagttgataagccccaaccccaacaaacccaggacaaccaatacccaaattcgtcccaaccattttaagtaagctggtagttgcgaggttttaatctgataggtatctacttgtctctggcgaccggaaatcttggtcaccttttgaaaagcacctttggagctgaacgtggaaagtatgagccagaccaatccgacagattgaaggaaaaatatccagaagtccacactcaaaatatttaaagcaggcaactggtaccagtagtagattagcatttccaaaactagggctaaccaggcaaaaacaaataattttcttttcataataacctccttgacacagatttattagttctattgtatcacaattttaatgttataatacaagaattataaaatttttttcaagtttccatattcgcctgcaacttttatttttggtataatgtaaaacagtaacagactagaaaaggaaaattatgaaactcatttcttggaacattgattctcttaacgctgcattgactgcagagtctcctcgcgccctattatcacgcgcagtcatcgatacacttgtgacagaagacgctgatattatcgccattcaagagacaaaattgtcagataagggaccgactaaaaagcatctagaaattttggaaagctacttccctggatatgccaatacctggcgttcatctgtagaaccagctcgcaaaggctatgctggtacactcttcctctacaaaaaccatctaactccaaccataacctttcctgagattggtgctccaacaaccatggattctgaagggcgtatcatcacgctagaatttgatgacttctatgtcacacaagtttatacgccaaatgctggtgatggcttgaaacggcttgctgaccgtcaaatctgggatgtacagtatgctgactacttagcaaaacttgatagccacaaacctgttcttgcaacaggtgactacaacgttgctcacaaggaaattgaccttgctaatcccgcaagtaaccgtcaatctccaggatttacagatgaagaacgtcaaggttttacaaatcttctagctaaaggttttactgataccttccgccacttgcacggtgatgttctcaacgcctatacttggtgggcacaacgtagccgcaccagtaaaatcaacaatacaggctggagaattgattactggcttgtcagcgaccgcatcgccgacaaagtaagtaagtcagatatgattgactccggtgctcgtcaggaccatacaccaattgtgatggagatttcattctaacagtggaaattaacctgatttcaattatcagataacagatattaaaggcttaaaacccgtagatctattgcaagggttttgagcctttatttcttatcactctaccttgttttaatccgctcaatttgaaaacggtgtcattttgtggtaaaataaatatatagatatatattaaaaggagggattatggaccacaaaattatcgaacgcaaatctctaactgtttcctctgttgtgaacggtttatctggactagcaggtattgccgtttatatcatgactgacctaaacgccctcctcctagacggagtcttttctctaatagcatttatttcgtccttagttgcagtttacatatcgaaaaatagccatcggaaaaccgagacttttcctcaaggactatactttctagaacctctctacgctatcatgaaatctctcgcaactctactactccttgtatttgctgtacttgaaacaagcgcgacagcctttgcttactttgttcatggaatcggtcatcaaatgactacaggtcccgttctcccttataccataaccatgttttttgtctgtatggggctttacctatacaaccgccatatgagtgccaaagtcaatcatctgtctactatcatattagcagaagcaaaaggcaaccttgtagacggactcatttcaggtgcaattggaattgcaattcttctgctctatcttgttcctatcaactcttggttcggcttcctgcattatactggcgacttctttttgacactagcactagcaatcatttcatttaaggaaccttggaacttattagtggcatctttcaaggaactcgccaacggaacgatccatttccctgagatacatgattctatctatcagctattggagccttacttaaaggaagatagcaatgatgtcgaaatccatattttcaaacaaggcatgaagattcgcgttaaaatcaatctccacaatgtccatcacgaaattatccaaaaactcttagaagataagcctcagatgctctatcttttgaaaaaacatcatgaatatatttcaatagaatatgcactataataaacaaaatctcggcttataaaccgagattttcgtattttgttcgatagccaatctgtaagattttaccatcctgaatcagtaggggacgcttaatcagcataccatcattagctagaagattaagtgcctgctccaagctaagactatcaaacttatctttcaagcctaattcacgatagctattcccagaagtattaaaatactttttcaattctagtcccgtcgcctccatccaagcttttagctcttcagcactaggcggtgttgacttaatgtcaatagcttcaaattccaatcccaaactcttcagctccgcctttgctgctcggcaagtcgaacattttggatactcataaaataaaatcatctttcacctcaaattctggattctcatgtcgcaagagccagattttcttatccagtccacctgcataacctgtcaactgtcctttctgattgagaactcggtgacaaggaacaataatagaataaggattacgcccaactgctcctcctactgcctgaccagaacgaaggcccagttgctgagccagttgtccataggtagtcgtctgacccatcggaataatcttcaataattgccagacatgctcttggaaatttgttcccacagcttctaatggaaggtttgaaaagtccacctgatcccctgaaaaatactggtcaagcaatcgagctgtctggtctaaaatgggatgggaggctaaaatagctttctcattcaagcctcgttcaaaatatttttgtccctcaaaccaggcccctcttaatcccttatcactagcaattaatgacatggggccaagtggactgtgatagacttgtttatacagcatgattagtttttattctgaatgacacgcactttgacaattgcatccgttgcttcaaatttagcaaccaactgctcaattttcactttatccgcttcatccaaatcaagtaaagtataggcatagtcacctttagacttattgatgatattatcgatattgattcccaactcagatacagccgttgtgatcgttgccaccatattaggaatattcttattaatcaaggtaatacgatacggtgcatctaggaattgtttcacatttgggaagttaactgagttgataatttcacccgtctccataaaacgacgaatggtctgacctgcagcaatggcacagttgagctctgcttcctctgttgacccaccaacgtgcgggaagacgataatgttgtccttgttgagcacttcttctgtcccaaaatccgtgatatagttcttgataactcctgcctcaattgcttcaaacaaatcagcattattaaccaattcaccgcgtgcaaagtttatcaaggttgttccttttctcatttgacaaaagctatccgcattgaaaagtcctcgtgtcttatctgtcaaaggaacatgaacagtaatgtagtccgcattggtaaagatttctttcaagtcatccacgcgtttgacatggcttgaaatggtccatgcagtttctactgatacataagggtcgtaaccgagaacattcattcccaaacggcgggcatcgttggcaatacgcgcaccgatagcaccaagtccgataacaccaagagtcttacctgaaatttctgtcccagcaaactgctttttacctgcttcaacctgcttaggtacatcatctcctgacaatgtatttgcccatgcagtcgctccgatatagtcacgtgctgacaagaggatggaagcaatgactgcctcttttacggcattggcattggcacctggagtgttaaagacaacaatacctttctctgttgcctcttcgattggaatattgttagtccctgcaccagcacgggcaatagcttttagattttcaggaaaatcaaatccatgcaaattttcagatcgaataataaaggcatctggatttgctgcatgatctccgtcaatctggaatttattgcctaattccttaagaccaatttgattgatattgttaaaagtacgtacgctaaataccatttatttttacctaaaaaggcggaatagctgccgccttttctttctttatttcattaattatttccgagtaaccaacggtcgtcttcactgatttcctggtaaagactccgctcgctcttttgcttgattttttgataggctagacgttctccatctattgggactttaccacaatagacatagcccaatttttttagaatgtgctgtattgtcttattctgctcgtgggtatcacagcggaaatccggtcctttttgaccttcaattaaaccttgcaaaaaagtttgtatgattccttgaccacgaaattcgtcagctgctgcaattctatgaaatgttgtatatacaggatgattgtgctgccattttccttcatatatggcctcatattctgcttcttgaccacgatgaacggcggcataagctgccaccttaccgtcaactagaccaacgtaacctctgccagaaagaatgtcatcaaaaatattctctttattaggatactctccctgccattgattgataccggaggttgctagaaatgcacgagcatcttcaagaatattgacaatagcctccatctcatttggatgtgctaatctaatttccattaagcattctccactgcaaattttttcatgaattcaatcaattcaaccacaccttgacgtgggaaagcattatagagcgacgcccgcatcccacctactgaacggtgacctttgatgtttttaaaaccagctgctgttgcttctttgacaaatttagcatctaattcttcacttggtgagacaaaaggaatgttcgctactgaacgctcttcttttttacgaacagggtttgtatagaaattagactggtcgatatagtcataaagcaacccagatttttcacggttgattttctccatctcatcaacaccaccaatttcttttacccattcaaagacgagtttagaaatatagatagaataagctggtggcgtattataaagagagtcattttctgcttgaatacggtagtccaacatgcttgaaagcattggttgatcattgaggaagtcctcacgaacaatcaccaccgtcacaccagcaggaccaatatttttctgagcaccagcataaatcatggcaaaatcttcaacattatagcgagccgctaagatgtttgaagacatatcagcaatgactggcacaccattggtgtcaggaatatcataaactgctgttccttcaatagtgttatttgttgtcaaatgcacgtaagcagcagttggatcaatatcatttttatcgaaggttggcaattctgcataggtaatatcttccgttgatccaagcaaaattggttcaaaggcaattgttttagacagcttcacagcctcagtataggcttttttaccccatgagccacctacaagatagtaggctttcttgccttgagcgaagttaaggggaatcattgtgaattccaaagaagctccaccttgcaagaaaataaccttgtaattatctggaatggccatcaattcacgaagcgttgcctcagcacctttaataatatcatcgaagtccttggagcgatgcgacatctccaaaacgctcattcccgaaccattgtagtccaagaattcagcttgggcgcgttcaagtactggttttggcaatactgcaggacctgcagagaagttgtagattgtcataaaatccctccattaagttagtctgttcattatatcacaaatattcagacaattccatgaaatatgattattttgtaaaaatattcggatttcttatatttattctactttctaaagcacctcttacttttagccataaacgaggcgcttgcctcacagggatttatcaggtttcaatgaaaattttatgaccagatttgactgtttggggagtgtcaccaattgctatctgcatattaatactcaatgaaaatcaaaagtagcttagctgggatatagttgaaggctggaagtatagagaactgtgttcgcgtcattaagccgaagatagaactctgttactttctcatttcaaggtaacaggctgaaaagatccactggagcttttcactcatcaaggctcttgacaacggataattttgatttccgaagagtataagcttgcataaacatacaaaaaaactaggtcttaacctagtccatgatatatatcgtatacttcttgttttttgagttggtagcgtttggccacttctttgatagcctgattaggttttatgccacttgcaatttccctttctacctcagccttcaagtccacttcatcagcagaaggatagacttcttcaccagcaccctcgacaataatcaagcattctcccttaagtggattttcttccaaatactctagtaattcggaaatgctccctctctggtattcttcgtataacttggtcaattctcgaacaaccgttacctgacgatcaccataaactgtcaacatattttctaaggtatctgccacacgatatggagattcatagaaaatttgcgtctcaggataggtctttttttcttgaaaaaattctttttgctgccccgattttctcggtaaaaatccataaaaaatatgtggctggggtgccaaaccagatgcaatcaaggctgtaattcccgccgatgctcctggaagtgctacaacaggaatatcctccgcaatcgctgcccctaccaggtcatgaccaggatccgaaatggaaggcaggcctgcatcagaaacttgcgcaatggactgaccagatttgagccaatcaatcaaaactggaattttttcatgggcattgtgttcatgaaaggatatttgcttggtttctacttcaaaatgtttgagtaggaggcctgtatttctcgtatcttccgctgcaattatatccacttctttcaaaatctgaacagctcgaaatgtcatatcctgtaagtttccaataggcgttggcaccagatataaagtcccaaaactcgtctgtcccttaaatgatttttgtactttcatcctaatctcgattcaataattctacacagaacatacaaggttcatcattatccctacgttgaccataagagaaggtacaaatatggaaaccatcttcgtaaatattctccaaattctccttaccaaagttggaagttttatggcctgtcttatcttctttttccaaacgttcgcgcaacttggaattttccaagcggagggtcgtattttcatcaataactccctgtaaatgctttttgatagcatccacttctgccaacgtggttagaagattctgcgaaaaatcatctagggcatcaaaaatttcttttttatccattatctccctttcttttattttacagagttatatactctagactattttgtagacttacgtttgcctgccacatcttcttagccttaagaacagcatccattttttcacgtacgtttgccgattccatcattttctcagataatatcagactcagaaggtcaaacaaacgtccctgctcagctttttccacagctaaagacactaggattccaacttgcaaataagcacgtgtaggctccaccaagagcaagtctgtaaatttctttgcctgtcccatcaaatctaaaaagtttttattttctgctaactttttcgcttcttcttgacttgaaaccagttgagctaagagattcgcttgtgtttttaacaagccctcctcttctaacattcgctccatagctggaatatttttaggaaaacctataatctgtgtccgactcttgatagtaggaaggacagcttcttcctgattggtcaataagaagatgtgaatggctgactgaggttcttcaatcacttttagcaaagagttggctgcgttagcatgcattttctcagcatcacgaataatgaaaacctgcttattggattcaaatccagattgtgaaaaattcttaactaattcacgtatcgtatctgttttgataacatttccctgcggtgcaataacagtaagatctgaaaactcatttgcttcaattagacgacaagaccgacacttctgacaaggaaggacgccttctttctcctgacaaaataacgattgactgagaaaaattgctatatcaaaactagcaaagtcacctgaaaataaataggcatgtgccaaacgtctctgctctaaaattgtcacaaaacgttgaaatacatagggttgtaagtttctaagttcttcaatcttcatgttctttctgcaaaccgtttcttaatgaccgccagagcatttgcaacaacagcctctagtggctggctggcatcaatctttacaaaccgctctggttcctgctctaaaatactaagatagccttgacgcacccgtctatgcatatctgctttttccatatccaagcgatccacatcacggtcagcattgcgggcaattcgagccagcccctcttctgtatcaatatcaaaatagagagttaaatctggctttaaaccatctgttgcaaactggttgagccaatgaatgtcacctatatccaacccccgtccaaatccttgataggcaatagaggaatcgataaaacgatcaatcaagagcaacttcccctgtgccaagggtggaagaatcttctctttcaaatgctgacgtcgtgctgcaataaacaataacagctccgtcttatcatccatcgctgtatttgcaggattcagaataatattacgaatttcttctgcaatagccaccccacctggctctctagttgtgactacttctggccccaattcctgcaaggctggcaataactgttgcaataccgttgttttccctgccccatccggaccttcaaatgtaataaaaaaaccgtttctcatctttccctcgctcttagtaccagtatgcacagttcagcacttcacttgtgaagactggttcttagatattcattccattttaccaaaaattagtcaaaaaatcacttgaaaattgacttgtttttaaggagaaaatcttttaaaattgatatatacacatattcggagatgcttatggttcgtttgaaaaatattttacttattttgcttggtgcagggctatttgcctttgggctaaattatttaatcatgcccaatcgtctattcgagggtggcgcaactggattgacgctgattatttactacctttttcatattcaaccttggataatgaacattgtgattaatattccattgttcatcctcgggtggaaaatactcggaaagaagactctctatctcagtatcttaggaacctttagcgttaccttttggttggccatttttgaaaaaatccatttttcaatcaatctacaacaagatttgatactcgttagtatcctgggtgggattcttatgggactaggattaggaaccatcttccgtgctggcggaacgactgggggaagcgatattattgctcgtataggtcataaattcctaccttactccattggacaaatcattcttgcagttgacatcctcatcctaactctgattgttattgtttttaaagacctccgaacagttctctatactttaatgatggttgctattgcttccaaggttattgattttgtcacggagggcggatatggtagcaagggtgttatgattgtttctcaaaaatctgaccaattggctcaggctattgattgtgaaatcgagcgtggtgtcacctttatcaaagcacaaggtttctacagcaaagccgatgtcaacatgatttactcggtcatatataagagccaactccaagagatgaaggagcttattcatcgtattgacccccacgcatttatcaccattacagacgcacatgaagtactcggtgagggatttactttagatcgagataaaaaaccaatagaacgccattaaacaaacctgcagtttcgctgaactgcaggttttatattattgattggtttcaagtggttgctctgcctcagactgtgcttctttgccttgctccagcaaagcagcaatgattttttgatcgcgtagcttaacagaatcgttgatagtctctgctgaccgtacaatagctgcctccaactcacgacgtttctgacgcccttcatctatagctgcaataatgccattattttgggcaaccaaactttctgccaatttggtaacagatgctactgaaagggtcggattctgagctgtgcgttccatcatcgggatggcttcttttgatgtatccgcaagcatttgaagggcagcattattagcattgacaatcgcatctgccgtctggctagacttgatagattgttgtaagatgcccaactgtgcaatggacaatttcattgttggaatagtattgcgacgtaacatcccaaggcgctgtttcatatccgaagaaaccttgaccagattacgcatctgcggtgtcgttgtccacgcgacatacaagcgactcatatactcagaatgttgttgttcgaggatattagcaacctctgttacacgtgccaacttctcagaagctacttgataatctaccgtagttggttgcagacctgccaagcgttcttgctctgcttttgctcgctgggcagcctcttgaccagtcgcttcaataaaggcgatgacccccaccaaattctcgatagacttggtattattttcaatcaaaagctctgcagaaacaatattgcgcgccaacacctcttcctgcttgaccacactggctgccatgctatccattttcttttcaatggtctgcgaatcgaaataaaattcctgcaaatcatttttggtctgcttgaacaggcgttggaagaaaccaggtttcttttctaattcagcagttgtggaaatgtccttatacttagccacaaaaccattcaattcacggttggtattggccaaaagctcatcgacctgtggaatttcaatcttcttctgttctgacaaaatgtgattgaccgtggcattgacttcttctaccgcttccttaccaaaatccaagaggacattttgattagctaagaaattatccaccaattggggagccttggcacgaatacctgtttgttgttccggtgtcaactgtgccaagaaagacacttttgaattatctccagtcggagtcgcttgaataagctctgttgtcttatctttggttgataaactattattagcaatctgatcaatatcgaaattaaatcctgacatcttctctattcctcttctcttttcatcatacgcagactgacttcaaaatctttcatatccgcttcgttaaattgtttgatggtatcatccaaatccttatcaaacatttccatggctgattttgcctgcaccaatcgttcttctgcgttaaaataatctttcggtgattttttgattttcaaataaccctgtaaaatatcgttaaaccgattcatattggcctcatggatagctgtcaattcttcccgcttatctgtcgccttttccagcttttcaagaataacaagattgtctctttgaatattacaataggtttctagaatttcaggagctaaatccgctatcatgccttgttcatccatcacagcattaccaccagtagaaacctgtgtgtcagtatttttttctgttttagcttctggcagttttaaatgatattttagttgcaaggtatctacaacttctttactttcatatccattcagatattttccaaatttttgatagagctgatctaattcaaataattgtcctaacagtctgtttctcaactgtaatacaaccttatcctcacccttttccaccaagagctcttgatgcttttcatagcccgaacgaatagatagcgctaatacttgcaagcgttttatagaatctctattcaaaaaacgctggatagcctctctcttgtaaaaatagccaattaagagcccagtgggcaataagatataccagaaactcatgacaaaaccgattgccaataaaacaaggagggccacaagtcctgaattatttttaccatatttcttatactttttatatttgtgccccatagagcctcctcacacatgatatactttattatatcacattcccctaaaatactagaatgatagctaaagaaaaaaaccgagaaatctcggtttttaaatatttttagcaacagtcggaaccaagctatccacttggatacctgcaccttcgaaaagagttcgaacttcttcaacatcaacttttccgtcaatctgcacttcgatgacaacttttccggacttggtagcaagttgcacagtagatacaatattataatccttatctgccaccaatcgaataattttttctaactcccctgccttattttcaacaaggaaccgagcgcgtactccttcttctccataacctgagacatgaagaaaagctgcaaaaatatcacgatcagtaatgaccccatatagttgaccgttgtcaacaactggaagaatccccactttgtttttatacatgagataagcagcatcttcaagactagcataacctgagactgtgataacattcttaatcatcacatccttgaccttagtcttattcaaaaggtagttcatctcgtaaatagataggctagttgccttcgatggactagcttctgcgatcgttccctcagtgaccaaaccaaccaacttatcattttcaataacaggtagacggtgcaaatcctgttcacgcataatatctgcagcgtgtgcaacggttgtatctggtgaaatataaacaactttacgggtcataaaatctttaacagacataggacttcctcctttggtaaatcatactttattataccacaaattcgaaaacgatttcaatatttaatgaaaagaaatgaaaatcaattcttaaattcaaaatatagactatttgaaatacaatggaatgagcaagactgctgactgagatagcccaaatctgctacaatcacagattgttagcatctttccaataaggcagcaacctctttgaagtcgttaacagaagctggcgtagtaacatagtgcagaatatagccagataaggcagcgagcacataaactttgaaactatagaaccataagtgcataggatttatcattttacctcctcaccgtctcaatcttccactccttccaacctcggaagcgaatggctccttgctggtctgtgcgatagacttggatattccggctgtcaaatcgttccaaggtttcttggtgaggatgcttgtagcggttgttttctccagcagataccaaggcaatcttggcaccgatatggtctaaaaattcaggataagaagagcctttggagccatggtgaccggctttgaggacatcgacaggcaggttgggataggtttctatcaagtccaactccccttgctccaggtctcctgtaaagagaaagttagtttccaacaagcgaccgtaaaggacaatggagtcattattgccaccgtcgcctgtcccgtctggatagaggacctccagataggagtcaaaaattggtaggcggtcgcccacttttaccacatggacaggaacattgatttttttcaaggtcgctacaaagtcaggcaccgtcagacttcccggcgacacgacaatccgaccaatctggacctgcttcgccacttccagcacatcccccacatggtctgtgtcggtgtgggtcaggactaaactatcaatcctatccacaccccgactatgcagatagggaatcaaagtccgctctgcatttgcctgccgagaccgctcctgccacgcttccttggccgcgaaatcgactcgtccgcctacatcaatcagaaccgtccgcccccgcatatcccgcaaaaagatgctgtccccctgcccgatgtccagcaccgtcacctcattttccagcgggtgtttggtgatgaaaaatagcagagcgaggaccaagctcagtcctagaagccatttctttctcctgtggaaatcgtagagcaagaagaggctgaccagcaaaagcaagaggaccagctcagacggcttgcccagtatccaaggccgcaatcccaaatcagccacccagacaatgattttctccataaagacgaaaaatccgttgatccaagtcatcttgacaactggcgacaggagaaaaatgactgacaaacctggcaagagtaggacatcaaagacaaaggaaaagacaaaggtcaagaggatagatagaggctgaaaggcatagaaataggtcataagcaccggcaaaattcccagtgaaatactgaggctctccaccgcagcctttttgacctgccccaaatcctcaaaatcaaagaccgtcagcaagaaagcataagtaaaagtcagcactcctcctgctgtcagtaaaaatcggggcagtatcaacagacagataaagaccgtcaccgcaaaattatccaacttccgcaagcctagattacccagaattttttggaccaaggaccgcaccaccgacacagaaaagcctgtcaaaccagcatagacaagggaaaagggaatttgtaacttatccactgtttccttggtcaagcccagacgcaacaaaatccaacgaaacttgtcgatgaaaaagcccacctgcataccagacagggcaaagagatgaatgattcctagactggaatagaggtcactcatctggtcaaaatcactatccagctccccaaacaaaagccctgtcatgtagtgactcatgggagccggaaaattggttttgacatagaccaaggcctgcctccgccaagttgacagccagtcaaaaacattccaagactggacagggacaatcttcttaatcgccgttagcttgacagtccgatagataccctgtgttttcagataggcctgatagtcaaagcccttgaaattccgctgaccagctggcaggctgacctctgcttccacttctagctggaccaggtctgccagattttgaaaataggtctgctcctcctgactggttaatttgtagaaaacctgatagttttgtccatcagcccgaccacgaaaagacaagctgtcgccattgatgtctatggtatctggaatgacctgcacagtcgtcacttgctctggggctgactgagctgcccgctcccattggaccttttggcatccgaaaaagagaccacacagggttagaagcggcagcgttttgaggaaaactgtcttaccttgccgaacaccaaagacagctaacaccaagctgagcaggcacattgtcaagagggaaaaagagtggactgcaaagtaagctgccaccgccaagactgccaggtgaacgggctggcaggggagcttactcaaccgtgacataaggccgaatgctttccatggtcttgtcgccaatgcccgaaacattgttgaggtcgttcaccgacttgaagccaccgtttgcctcacgataggcgataatgtccgccgcccgcttggcaccgatacccgaaatggtctgcaagtccgcctcagtcgccgtattcagattgaccagactggtgcttttttcttctggagacatagcagagctggcagtcgtgctggccaccaccgagatgttttcgtccttgctggctacatagaccaccgcctcatcgctgagcttctgagccagattgatagacttggggtctgcctgactggtcaagccgccagctgcttcaactgcgtcattgacacgcgcaccagcttctaaagtatataacccaggcttttccaccgctcctttgacatcaacggttagctggctgagctcctcactctcttctgtactggtttcctccgtctgctcctgactgctagaagcttgctcggtttgaggaaaatctgtcagtcctgtttgatcagacttagcaggttggctgaatattaaaaacgtcgccattagcaagccagccactgctggcagagcaatttgccacttgtattctttaagcatttctatataagttttaatcgtatccataaattacctccacctatatagttcgtaaaaaatacaaaaaacccgcaagctgcgagtttcatttacttatttttatccaactgagtacttggttgccagaagaagctggcaatatagctaaaggcataggtcaatcccaagataagagcaaccagcaaaagaactgggatacgatagatataagtcaagatatttggttttttcttggtttggaaagatgccgcatggtcatctaagcgtttgaactcagcctcaattcggctagttacttctgctgtacctgcatcatccatacgcttgatgtccgaaacatcgataggatttccaaaagccacatcgattcgctcaccagctaagagccccttgatagtcatgggacccacataggtagctggcatgagtttgaccttggctgacttggcgatgaccgccacaccaccttttagctcagatgaatgacgacttccagaaggaaacatgaccagcgaacggtcactttttttcaacatgttaactggatacttgatggctgccatgccaggattgtcacggtcaattggaaaggctccacattttgaaatccaccaaccaaaaccgcggtctttgaagagttcttttttagccataaagatgaactgcttgggagcagctgcgtacccaagaaagactggatcccagaaggttttgtgcggagcgataagaatataattttcctcctgtggcaaaatcttctctctatcatgatagtgaatattgccattgatggcccacaacaagaatgttaatagtgttcgtagataagaataaaacataaacttctcctttttcaatccctcctattatagcacaaatttgcttcagggcgaaatgtcatattcattcaaatttacggtcaaaatacccactatttacatatcccagacttgtcaaatatcctcgataggtttacaatagaagcatgattacaattgaacgtgtattagaaatattgaaggcggatgctaacttccgccatatcaaacagaatgaccaaactgacagcacatggacggatgtccagtttgacgctctcagctatgacagccggactgttagcccaatgaccctcttttttgccaagggtttggcctttaaaaaggaatttctggaaaaagctatcgaggccggactggctttttacgtgtctgaaatcaactatgaggtcggcattcctgctatcatcgtccacgacatcaagcaggctatgagcctgattgccatggaatttcatggtcatccccagaaacagctcaaactcctggccttcaccggcaccaagggtaaaacaacggcggcttattttgcttttaacatccttaaacagagcaagaaacctgccatgctttcgaccatgaacaccacgctggacggtaagaccttcttcaagtccaccctgaccacgcccgaaagtctggacctctttgccatgatggcggaggcggtcaagaacggcatgacccacttgattatggaggtgtccagccaggcttacttggtcaagcgggtttacgggctgacctttgacgtcggtgtcttcctcaacatcagccccgaccacatcggccccattgagcatccgacctttgaggactatttctatcacaagcgccttttgatggacaatagcagagcggtcattgtcaatgctggaatggaccattttgaagtcgtgaaagagcaagtcagctccaaagaccatgacttttatgggccgacttctgaaaaccagattagtcagtcagcaggttttgattttacagcgactggcaaattggctggccattacgacatccagctgatcggtggcttcaaccaagaaaatgccatcgcagcaggactggcctgtctccgtttgggagcaagtctggaagatattcacacagggattgcccaaaccaatgtccctggtcgtatggaagtcctgacccagcaaaacggtgccaaggtattcgtggactacgcccataacggcgatagtgtcaagaagctgattgatgtcgtcttagagcaccagacaggcaaggtatttttgattttgggagctcctggtaacaagggagaaagtcgccgcaaagacttcggtcttctgctcaatgactatccgcagattgaggtgattctgacagctgatgaccccaaccgtgaagacccagctgctattgctgaacaaatccgtgcccacatgacccgtacaagcaactttatcttggaccgggaagaagccattcgcacagccatgagtcagacaagctctccgaaagatgccgtcatcatcgcaggcaagggagccgatgcctaccagattgtaaacggcgaaaaggccgcctatgacggtgatttggaagtagcaaaacaatatttgtaacatacggtccttgttcacaaacaaggacttttttataacgattctcattaaattaaaattttcagaaaactctttgttttggtaaatttttttgatataatactggtcggaacaaattattaatgaatcatattctggaaaggaggagtttgtgtcttcgattcaagcggaaaatatccaagtctcttacgacaatcggattattattgatgaattatcaacaagtattccaaaaggaagtataacgacaatcattggtgccaatggctgtggaaaatcgaccttgcttaaggcgttgacaaggattattcctgttcaagaaggggctatctatctagatggacaagccatttcacaactgccaaccaaagaagttgcaaaaaaattggccctgctccctcaggtcttagaagcgacagaagggatttccgtttatgaactggtctcctatggtcgctttccgcatcaaaatgggctgggacatctcactgatcaggatagagagaaaatcaactgggccttggaagtcacccggaccgctccctacgctaggttaccagttgatgatttatcaggtggtcagaggcaacgggtttggattgcgatggcacttgcccaagatacggataccattttcttagatgaaccaacaacctatcttgatctcaatcatcaattggaagtcttagaacttttaaaagaactgaatcaaagccgacagaaaaccattgtgatggtccttcacgatgtcaatttatcagctcgattttcagattatatgattgccatgaaagagggagatattcgctaccatggatctgtgtccaatatgatgacaactgagatacttagggacatttttagcattgaacctcaattgatgcaggttgctggtcaagattaccctattttgctaacttacgatttaaaaaaataataaggagaaaaaatgaaaaagtttttagctatttttagtttatttgttgggctggttttcttaacagcttgctctacctcttcctcttcaacagacgtagaactgtctagcatgccaaagattgaaggcattacttaccacggtgacattccaaaaaatcctaaaaaagttgtcaactttgcttactcttacacaggctatctcttacaattaggaattgatgtatctagctatagtctagatttagagaaaaatagtcccgtctttggagacaaactaaaggatgttccacaattaacaacagcagatacagaagcgattgccgcacaaaagccagatgtcattctagtattttctggtgatgataacttagaaacactgaaagaaattgctccagttattgaaatcacttatggaaagagtgactacttgaaaatgctgacagatattggtcagatttttggaaaagaaaaggaagcacaagcctggttagatcaatgggataagaaagttactactgcaaaagaggaattgaaaggattgattgatacaagttcaacatttactgtcatggacttcttcgataagaacatcttcctttatggtaataactttggtcgtggtggagaattaatctatcgcgctctcggttttgccgctcctgcaaaggttcaagaagacatcatcaataaagaaggctggtttggggtatctcaagaagctcttccagaatatgttggcgactatgtccttgttaacgtcaatgataaaacaaaagaagcagctgcctctctcaaagaaagtgatatttggaaaaatctacctgctgtaaagaatggtcacgtcatcgagatagactataacctcttctacttctccgatccgatgtctttagatttacaaattgacgcctttgtctcagaaattcaaaaacttcagtaaaaggactggatatatgaacaaactagtaagttctcgttatcccaaaacaaagccaaagaatatttggcttgtttttttcatcatctgtctttctttcatagctggagtctatcttagtttacgctttggagctatttcttatagccaccaacaactgatagaaaccctaaagcatccactgacaaattcttccgctcaggatgttatcatcgatttacgcttgcctagaatggtagccgccatcttggtaggagctgccatggcccaagctggggcaatgatgcaaggaattacacgcaatccgattgccgatcctggcttattaggaatcaatgctggagcaggacttgctctcattgttgcctatgctctgttcggtggtttgcactacagtcaaattttattaatatgtttactgggctcctgtctggcagccggcctagtctttggtctagcttatcaggtgcaaaaaggctacaatcaactacgtttaattttatctggcgccatggtagcaagtctattttctgctattggtcaagctattactatctactttgatttatcaactgcagtgattggctggcaagctgggggattggtacaggtaaactggaagatgctggccatcattgctcctcttatcatcatcggcctcatccttgctcaactcttttcgcatcagctgaccatcctgagtctcaacgaaaccgttgctaaaaatctaggtcaacgaaccttactgatgaccttggttttgttgggaattgtccttctactctcagcttctgcggtagctcttgtgggctcactttcttttatcgggctcattattcctcactttatccgcatgtttacagggaaaaattacaagctactcttgccattaactgcctttgcaggggctagtttcctcatctgggtagatttggtttgccgttctatcaatccacctgttgaaactcccattagcgcagtcatcagtatcattggtctcccttgcttcctatggttgattagaaaggagaaacacttttgataagacatcacaactatctaaaaatattcacattcctgctaatccttttatttatcattttcctactttccttatctatcggctatagcaattcatccttttcggatttcatcgacatcatgagtgggcgtgccagttcatcgactctacttatcattggacgaattcgcttacctagaataatcgcctccattatcggaggggcttctctggctttggcgggtttgttgctacaaactttgacccgcaatcctctggcagattctggaatattaggaatcaacgcaggagctggtcttgttgtggcactatttgtcggtctctcttcaaaaatcagccctgtcttattgagtctcatgcctctatttgctatgatgggcggtggattaaccatttttctagtttactggattgcacgtaagaagctgtacggtatccatcctgcacgcttaattatcacgggagttggaatttcgagcatgctgtctggtatcatggtcagcatcatcagccaattagatgactttaagatggaatacattgtccagtggctcagcggtcgagtaaatggtggagattggaaaactatcgcaatctatactcctcttcttctattggtgtggatggcaacgtttagtcgaagtcgctcactcaatattatgaatctaaacgaccagacagccatggctttggggctccacttacagcgtgaaaggcggattaccttgatattggctaccgccctagcctctcttagtgtcattttagttggtaatatcaccttcgttggtctcattgctggtcacatagtgcgcaaatggttaggaaatgaccatcgtgtcatcattccagctactatgataataggaagcttcattctacttctagcggataccataggacgagtactacttgtcggaacaggcatcccaaccggcatcattgtctcccttatcggcgctccctattttctgtggttactaaaacaagaaggctagatgactccagccttcttgttatttttctaggtaaagttcaatatcctctttaagttttaatggactagttgttggtaaatatcgtttgaccacacgcccttgtctatccaccaaaaacttggtaaaattccactcaattcgacctcctaataaggttgatttttctttcttaagatagcgatatagcggactagcttcagatccattcacagcaattttagcaaaacgaggaaaagttgtaccataattcaagctacagatctgattgatgtcttccgcagaaccgggagcctgatttaaaaattgattacaagggaaatccaacactacaaaaccgttgtctttatagctatcatatagctcctgtagttccttgtattgtggtgccaatccacaacctggcgctgtattgactataagtaaaacttgtccttgatactcagccatggactggtctgtgccatcttgtttttgtactgtaaaatcataaatgctcattatatatcctcctctagtcaaaataagtgaataaatgttccatttcatttggtgtgagttgtctgtatgtacctcgttccaaatcccccagttcaaaaccaccaaaggaaatccgcttgagataagtgaccttgacaccataggctaaaaacatctttttgacctgatgaaacttaccttctgccagcttgatggtcgctctgctatggtccaaagaagcctccaagacagtcaaatctgcaggctgacaccgtgttccatccaagaaagtaacacctgaggcaaaaaattttgaagcatcctcagccaagcatccatttacctccacatagtagaccttgtccacatggtggctgggatggagcatgcgataaccgagcggaccattgttggtaatgaggactaggccttcggtatccctgtccaggcgaccgactgggtagagaccttccctactgtcttgcggagaaatcaagtcgatgactgtctgatgctcctggtctgtcacggcagaaacgactcctgctggtttatggagcaaataataggcggaaccttctaaggcaacttttttacccgaaacttggatagtttgtaactctgggtcaacaatctggcttaggctttgagctgcttgtccgttaatcttgatttgctgggctttgaaaagttttttaacttgcttacgcgagccaactttggctttctctaaacatttgtccaatctcatgggactattttatcacaaatcatatagcttgactctttttgaaaaaagtttataatactagttagtgatatatttttttacaaaggaaatccaatcatcctattggatttcccattttttcagtaagggagaaaattcatgggacttttacaagatggcaaatgggtggatcaatggtatgacaccaagtcaacaggcggtaagtttattcgtagcgtcacacaatttcgcaactggattacgccagacggacaggcaggcccaacaggagagggtggttttaaggctgagtctggtcgctaccacctctatatttctctggcttgtccttgggctagtcggaccttgattatgcgaaaattgaagggcttggaagaccatatttccttgtctgtcgttcatcccctcatgttagaaaatggctggacatttgaagatggtcctggtgttatcaaggataccctctttaacagcgattatctctatcaggtctatttgaaggctgatccacactattctggtcgggtgaccgtgcctgtcttgtgggataagaaaaccaataccatcgtcagcaatgaatcggctgaaatcatgcgcatgtttaactctgcttttaatgatattactggaaattacgatgactattatccagcaaacctgcaagccgagattgatgccatgaatgattttgtctatccaaacatcaacaacggagtctacaaggcaggtttttcaaccagtcaggcagtctatgaaaaagaggtcaagaacctttttgctgccttggataaactagaagagcatttggctgataagaactatctggttggcaatcagctgacagaggctgatattcgactctttaccactttggtgcgattcgatcctgtttactttgggcatttcaaatgcaatatcaaggccttggttgattatccaaacttgtggaattataccaaacggatttacaaccatgctggcattgcagagacggttgactttgaccatatcaaacagcactactacggtagccacaaaaccattaacccaacaggtattgtcccagtcggaccagacttggactggacactataagatataaagagagatgacatcctcccttttcgtatggtataatatttcagatttttttaaaaggagattgacatgtctgaaattacagcaaaacgtgtttccaattatgaattattttatgatctggtctttgtcctggccacttcttcactgactggcttgctacatgggaaccacatcggtttcaaggaagttacaacatttatcactacaaacttgattattatgaccttgtggatgaatgaaaccatctatctcaataaatacggcgaacgggattttctggatattttcaccattattccatccatgtatctgattggaaatatgtcacttaattttagcaacgattttgcacaaacagctctgccatttaacacctttttaaccttgtcttatgtcattattctcctacaatattacttaagaggaagacggattggctttaatgaggacatcaaggcaaccttgcagatgctggcgacttatattgttgtctttgccggtgcaaccttgttggtcatcttcaagctatggaccaatgatgaacggatgctgattgtctatattattcccttcttgatttccttcttcttccaaaagagaatgagtcatgaccccatcaacttcccacacatggtggaacgttgccagctgattaccattatcactttcggtgagatcgtcatagctattatcaaaaattacccgcttctagaacttcctttggaaggaatcctcctcttcttcgcaatggcgactctgttcatcttctatatttctcaaacctatctcactatcgaccatcaccgcaaggcagatgcgactgttctgctatacgctcacttggtaattgttcttggcttgaatttcttcacagtggcaatggagcttttccctagtcatcataatgatttggccttgcccatgctgattgtaggaaaccttatcttctatagtggtatcctttcgacctccttctataatcaacaagtccatcaagttggcaggagagggctgttcatctatgctctcattttactaattggaaatgttgccttattgctggatggtcattcaaatatcctactatttgttatcttaaacctgctctcacacgctatggttgcctatcatgttattcgcttcggcaaagccaaccacagtttgttgggagaagatatgtaatcattcagtttattacagtaaaagaacaaaaaagcaaggagacttcctaattcaaagccttcttgctttttattataactgtatctaactatttcaaaaataagtttaaatctcccttatatgcagcccattcggaagttaaaaattctttttttaactgataatgaacaggtgcttgttgttctgtcaagaatgggtggacatacttatcaagctccagccagccttgccaaccgatgtggatcgtatcttgcataaaataatctatccccccctgctccgacaaatcagcaatatgattgaaaccttgactggtcaactggtacttaatctttgctactgttgcccgatacatatctttattgagaccagtgtagttcatccaacgttcattaaccgggggaattacaaatagcacatcagtctgatgtttagcaaattcattcaaaaccagctgaaaatcattgtactccggtgattgcagataagatatttttgtctgggattgtttgagttttttgatttttgactgaagacgatttctataaaacctatcatcaatttggaaatcatttgattgagtagaacgactcccgtcctcattagccactttactcaagcggtcataggaaaaagtctctggaagtttcatcgcttccgtttctaccaatcctaaattactaccagaatcagcaaagcgactaaataaggcatcttgcttttctaataaataggcttgccagttcaactgctctctatcccatttcgacaattccttaccactagctactttttgaaacattcctgtcaaactacagtctgatttaagctctaagaaacgctttgctgcatatctatcatagtcatccttagcacttgtttgcagaaaatgagtggcttgatcactactaaaatattgttcaaatgccttagatgatgcccctttgggtgaaaaccattgaggagaaacaacatagatagcctgactattttttaaatgtgccccaatctgttgcatgccaaaatattgtgtcagcgaagctgcaccacgttgtcctaacaaatagggagtatactctctctgataggcatctgccaacactgacggatgcatactatcaaaacgtgaccattcacttgacccaaagaaaggaacaaaacgatgatttttatctcccagagccctatttttcttatatttgctcttaaaactaatataagacaatgctactgcatcttgtttttcttctttgaaatttgaccgagaagaactcgggaaaaacaacaacgtgagaataactaaaaacgttgcacaaatcacaggtccaaaaatctgccacaattgcttacgcatgcatcaactccacaacaccagaaatgattttgttagctgtattccaatcttcacgaccaaactctgaaactggaactgtaatattaaaacgactttctaactccacaataagttctacagttcccatactatccaaaacacccgcatcaaataggtcttcatccatcatttcagatacatcttccataaataattcttcgataatattcaatattgtttcttttacatccattttttattcctttctacgattcatacaatcgttacctattgtctacttgaaccacaatttatctaaaaatcctgaaaatatcaagaaagagaacatgaccgtatggaaggtcacaaacataccagcgaaactcgtccaacgattatccggcaatggttcttgcccagctttttttcgagctaaattaattgatttcttcttacgaatccaagcatcattgatgatcaaccccaaagcatgaaagagaccatatgcaatataataccatgttacaccatgccacaagcccatcaagagcatatttagcagataggcaacattagataccgtatttcgatttttgaaaaccttatgtttcaacaaagtcttaaccagacgcatgaagacgaaatcacggaaccaaaaagataagctgatatgccatcgattccaaaactccttaagatcacgcgatttgaacggttgatcaaagttaattgggcagcgaatacccataagattggaaatacctatggcaaacatggaatagcctgcaaagtcaaagaataattcaaaaccataaagatacataactccaatagtaggtaagttaaaccatccaccttgatccaaggctactgcctttaaaggctccagtaaagtatgcccgataaaataggctagaataaacttatataagaagcccatcataatataatgcacagtctgatcgagcatatttaataactcagttcgctcaggaatttgtttgtaatcttccgtaaaccgtctataacgatcaatagggccactcgaaatagttggcataaatagcaaaaatcgcaaaaaacttcccaaactaaattccgttagtaaaccgtcccgcatttcaatcaccattccgaccgaccgaaacgttaaataagaaatacctaaaaaaccgaaaattgccccatgctgactaaaagtcggtgccaactttacccaagccaacggaaaaacagctaaacacacgattagatagaagacccagctttgatttgcccgttgacgataatgcttgtagaaaaaaatcaacattgtctgccaaataatataggccaataaagacagcaattgcattgtctttgtacctgtaaacatcaagacaatgaaggctaaactaacacctgtttcatacaaggggaaacgttttttaaaaaagagtcctataaaaattggtactagcgccaagactagatagaaaaagtacaatggatttccataaggctctaactgaggtagctgtttaaaaaactccatcattgagcattcacctcagcgatcaaccccttaatatcaatcttcccatttgcagtcaaaggaagactgtctcgataaataaacttcgaaggcatcatataatccatcatccgttcttttaactcctgcttgatgaccttggttaactccaactctcgatcgaactgctccataatccctgctttagggacaacataagctaacagattttgcactttatggtcagcattataacgtggaacagccaccgcagcctcaatataggttgatttatttaggtgttgggcaacttcttccaactcgatacgataaccattatatttaatttggaaatccatacgcccaccatagagtaacagaccttcatctgtcattacacccaaatccccagtatgataggcctgtaagccgtcaaactggaaaaatgccgcctcggttctctcaggattattcaaatatcctttagagacagcaggacctgatacaacaatttctccctgttgaccattcggtactacttgaccatcctcatccaaaataaaagttggcgagtctggtttggtataaccaatcggcaaacgtttataattcaccagcatctcatcagtgatggcaactgctgataaggcgactgtagcttcggtcggtccataagcgttaacaatcacagcttttggaaaacgttcgcggagcttctgagctgtttttacagttaactcctctccgtcaaaatagaaatgcgtcaaatctggtaaatgttccccatcaaactcacgagatagcaaagccatatctacaaatgatggtgtcgaagtccaaatcttaaatggcaaagtttgaatagctgcaaataaagtcttaaaatccaaagtcaactctttcggtagagcaaataaggtcccaccaagggcaagcgtcggagcccaatacataaccgacaagtcaaacgaataggaaggttgagctaacatttgcggtcgctctggtagcgcaaactccttatcccttatcatccagttagtaaagctgagcaaattgtcatgcgaaatttgcactccttttggtttacccgttgtcccagaagtgaagataatatagtaggtatcatcttcgcttacaggatgtatcaactgataagtcgacttcttctcaaaaatggcttcaacttcagacaaaccaagcactggcaaacttgtctctagcggaaagtctgctaccgcaaacaccaaactcggctctgctatttccagaatagcttcaatccgatccaaagcagaatgactatctacagggatatacggatggccagccttggttaaggctacaaagattgccaacatctggtactcctgtccgccaaaaacaaggacaggagagtttgctggtaaatccaaactatcaatatgggctgctaaagaatctgaatctgcctttaaatccccataactatacaactgtcctagataatggtaaacagggtagtcaggattttctgtcgcaaaatgctctacccgctctaacatactgctaatcatttttatactctcctctttaaaactcattatagataaatcctccctgtccaatgtctaaataactatacagatacaaaagtagtaacaatataaaaaaatagaacagggttctacagataaatcgtacaactggatgttgcatgttctatctccttccatctcttattcctgcgaattgctttaaatacaatgtctagtcaatcttgacttacttcgaactcattccattcattagatgattaattttaaatcaacctatattttaccataattttgtcaatttatttcttttttcactaaaaaatacaagaatatacctgttacacaaagactgtatttttttatcaatgcaatataaaaagtttagaacaattacatcctaaacttttcactctttaatttatctaagaaaaattacaactgagactcaagaaatatggaattcgtgtcaacatctcattcgcaaaaaatgtgaggtctattacataatttcttgcacaatctctagtttagatgcctagatctctccaatatttcatacgcttttcatttgaataaaagctcacatgaaccactgttctctatccatatgaagtcaacgaaaaatagaaaccttagctaaaaatacctttgacaaaagttgtaaaacgagtccaaagttcccaaaaccatgaagacttttcagaagatttagatggaatttcagcttttccaataaaagttattccttgatttttgaaattggtattttcaaatttagcttgtatctgaatactatttggatttctatctccaatcgctttttgaagctgctcacccgtaatcggtttgtgttttcctgctacagtctgatcagcagttactttctcttcagcatgcaccgttgtcgcaatcacagaggtaactgcgagagttgtaatgagtgttaaagctactagttttgaattagcttgtttcatgaaatgtctccttttacaaagtattagtttttttaatatgaaggtttataaattaattgcgctaaatgttataagattattaatagattaataaatcaaaactgaattactatccatttttaaacagtctttctaaatgaaaaccatgacgaagttgttcaaaaaactttttaatggtactccaaagagattcataccaagttttttgttttttagaaccagcagctctcggcatcgcaatttttactggaccatcatgagaactccgatttgatgtatttcccttaacaagcacctgagtatttctcattgcagagctatctgatgaagtaaaattatgcccctgtgcaccagcagttacgccacctgcagtgctcatcaacagagcaagagccatagcacacagaccaactttataactacgttttgttacaatacgtttcatttttgaaatatctcctttatacaatattcgcccttttttagacaatgtagtgccagtatatcacaaaaaaataacgtaaatcccaactttagagaaagattagataaaaaaccattaaattccaaaaaataaaaatattaatataaaaactaggaaataggatacgctcctttcaagagaaccttgtctcgaataagcgaagtaataaaaaagaatatccctaaaaaatttaaaaccctctattttcacagagggcatactattttgagttatattattaaagttatgaatgtatagatgaaaaagatttttaagagggtaatattatagaaaattaaaaatttaagaaagattaatgaaggtatgaaggatttgcaaatttaattgactaaatattacaagaatataactctaaatagtaaacattctacttaacaccatccaactccacgacagattgcttcccaaaatgtttttacactactccaaaaagaatcaaaccatgatttggtttcagatggtttagttgtagaattattcacaggtttcaaaactatgcccccctgtgtaaaagaccccgccggagtttccaacagcctatacactttggcatcacctcgagtttcgacactataggtacccgtacttgcatgtgcagttgcaccacctgcagtggtcattagcaagaccaaagccatagcactcaaaccaattttataactacgttttgttacaagttgcttcattgttgaaatatctcctttatacgatattcgtctctacaaatgatagtatagcacaaacagacaactcaaattccaactttagaaaaaggttagataaaaaactataaaactccaagatatgcatattaacacaagaacaaaaatacacatgcaatattatatttatggttcaaaaaacttgtatcgaataattgtggtaataaagaaaaaatgtttaaaaccctctattttcatagagggcatactaattcgagttatattattaaagttatgaatgtatagatgaaaaagatttctaagagggtaatatatagaaaattaaataatttaagaaagctagtgaagtatgaaggatttgcaaattaattaactaaatattacaagattataactctatgttacttactaactttgagcccagttagtcccacagaacaacataatgcattccagaatgtttttacaccaccccaaaatgaactaaaccatgatttttgtacagaagaagccattggaggcacagttgggttgacaggctctaaatttccaacctctccttcattgaaagactggtttgattctttcaattttagaagtacatcaccacgctgtactaagccaactgatgactcaaggtgctgctctgcatttacaactgcaccacctgcagtagtcatcaacaatgcaagtgccatagcgcatgcgccaactttataattacgttttgttacaatatgtttcatgatgaaacatctcctttgtatagatatttgcttcctcctatcggaaacgtagtaacagtatagcacaaaaaaataactcaaaaaccaactttagaaaaagattatataaaaaccagaaaactacctgaaaaaattgaaaacgttatacaaaacgtagagaaaatgatactatttcgcccatttcacttatccctatcaattttcaacatgataaaggatggcaatacctcttgttgaaattttctctcacatccaacttaatgttatatataatccattcaaatatataacaactgatatggattatcagaatagcaaaaggcatgcccttaaaaatataagttacatgccttttcacaatttttgtcaaattcataatggaaaaagaacctagattcattcagaaattatacttattgtactgttacaaccaactttatgtctaagaataatcgtttacaacatactacactaatttactcgctgctgcttggtcgaggatgaggatgacattgtcatggttttggaggacgcttgctgggacatcttctgtcactgccccttccacagtcgccttaatggcgtcagctttttcctgaccataggccatgagaacaatggtcttggctgccataatgttggcgatgcccatggagatagcttgttttggtacatcttctggattgtcaaagaagcgggcgttggcttcaatggttgatggcgccaattcaaccagatgggtctgaccatcaaatggagcacctggttcgttgaaaccgatatggccgttgcgaccgatacccaaaatttggaaatcaaccggatgttcagccaaaattttattgtaacgttctgtttcagcaactacatctgtcgccaaaccattcggtaaataagattgtttaaacggtttggtattgaaaagattttccttcataaaatgaatataggattggtcgctctcctcacctaaaccaacatactcatccaagtttacagatgtcacatccgaaaagtctaaatccgactcacgaatcaatctgtaaaattctaacggactggagcctgttgccaaacctaataccttggtacctccgttcaatttttctctcaaaatgtctaatgctacagttgctccttcaacttgattgtttactacatgaattttcataacacacctctttggtctataccattttgtttttctttattatatggtatagaccaatttttgtcaagaatttatacttatagagtattacatcagcacgaataattttaattctcttcccatccatcaagacttaagtgtctaactatgatataatacatttatgacagatgtgcttttttacttattttttattggtattctgttctgccttactggctattttatttctaaatcaaaggtcctaaagtttattttctacctgattggtggtctattggtggctttgccatttgccctattgatttattttacctatattttattttagtctaaggagtgaatatgaatactgcagattttgattttgatttacccgaagagcttatcgctcaagtaccccttgaaaagcgcgacagctctaaactattgatcctcgaccgcgaaaaacggagcatggttgacagtcactttgaccatatcatcgaccagttgaatcccggtgatgctctggtcatgaacaatacgcgtgttctgcctgcccgtctctatggctacaagcctgaaactatgggacatgttgagcttttgcttttgaaaaatacccaaggtgatcagtgggaagttcttgccaaaccagcaaaacgtctgaaggtcggtaccacagtcgcttttggtgacggacgattaactgctactatcgtagaagaattagagcacggtggaagaattgttgaattctcctatgaaggtatcttccttgaagtcttggaaagtctaggcgaaatgccacttccaccttacattcatgagaaattagaagaccgtgaacgctatcaaacagtttatgccaaggaaaacggttctgccgcagccccaactgctggactacatttcacccaagagttactcgaaaaaatcgaagctaaaggagtgaagctagtctatttgactcttcacgttggacttgggaccttccgaccagtctctgttgataacgttgatgagcatgaaatgcactcggaattctataacctatcagcagaagctgctcaaaccctcaatcaggtcaaagatagcggtggtcgtatcgtcgcagtcggcacgacatccatccgcaccctcgaaaccatcggtaataaatttgatggccgtttgcaagctgattctggttggacaaatatcttcatcaaacctggctacaccttccgaatcgttgatgccttctcaaccaatttccacctgccaaaatctactttggttatgctagtttctgcctttgcaggtagagaatttaccttagatgcctataaacatgctgttgaagaacgctaccgcttctttagttttggggatgcaatgttcattcaataggctgttatcaccaaattattctgaattctgattttattggagggccctatgaacaagattgaaagccgccatcagctgatcctatctctaatcatggagaagaaaatacatacccagcaggaattgcaagaattactagaggtcaacggagtctccgtcacccaatctaccctctcccgtgacatcaagatgctcaatcttgtcaaagtcaacgaagatgattcttctcactatgtcatcaaccccattgctcctactcgctgggaaaaacgactgcgactctatatggaagatgctttggtcatgctaaaacctatccaacatcaagtggtgctcaagaccctacctggattggccaactcattcggttctattttggatgccatggaaattcctcaaattgtagcgaccgtctgcggtgacgatgtctgtctcatcatttgtgaagatgtcgagggggcacaagcttgcttcgagcacttgaaacagtttactccaccatttttctttagtaaattataaaaatttgtgttcacaaacaacatacttaattttaaagataatttttcaaataaatatcaataacttccctttatactcataaacgaaaatctcccgtaataagatttattacgggggatttttagtagccgataaaaaattatcctgttattcatagctttctagtttactttttgtacaaggcaataagctacatgctatacttgggtacagcaaagcgagtgaaagaaaaactagataactatataattacaattagaaagccctgaaccttaattcaagtggctacattactccttcttccgccggcgactagcaaatgccagaccaatcatcccaaggagagagaatccaagaccatctactactcctgtatttggcaattctttcttctgagaagctgcttgcttggaatttgactgctcactgcttggttttgatacgagggataaaggtgtgacagatggtccatagtttgatgtcaggtatcccttaaaggcagggcgtggttctgcttggacactttttcctttagcagtaatcagaggtagcttgccttctggtaagggctccgctttgacgctgtctccctttgctgtcacaggaactaacgcttcacgcgctgcttttacttctgccaagtaaccatcaacaaacgcttggttatttctacttagtttccaatcaatcttgttcaagacctcttttaaagtcgccacgctctctggtgtataggaatttaaatcagtaggaatcttcccaacttcttctcgcaaatctcggtactctgccaaaaaataatcagaattgttttccgtaaaactgtgcaaaagttttttaattgagtcatagctgtaaggcttgcttgggtcatctgcccataccgcaaccatactaccaataatgggtaccttagtattctcagatttcggtacttgatcaaaccttgtagatttagttcctcgaagaccttgatcaaggttataccatcccaaaccttctgcttcacgtccaataacatagtaccaagcatcatttgtattaagaattttatgccctttttcatgaaggaattttgaggaagcaacatcatatcctccccaacctcctgtccagaaagaagcaataatgtctttatcaaaagtacccgaactagtatcgtggttataatagataccatcattgaaagccattggctctaaaccatgcttcttgacgatagctgctaaatcattggcatattgaataaacttaccataatcaccttgtgtctgaagaatgtgccatccagaagcatttgtagcatcgttagcatactcatctaagccaatattgaaaattttagatttgcctgcaaagtaactagcatatttatcaattaaggctttagtaaaagcaactgcttggtcattttttaaatcaactgtacgtgcagatgttttgccattataactaaattttggcgattttatccccaattcttccattgcttctacaatcgcatccatatgacctgggctattgatagttggaataatggaaatatttttttccttagcataagcaagaatatcatccatctcactctgacttaaggttgtaccgtttggatcgtcataataatgcttattaccatttattattgcttttctaactgcttcactgtcatacaccttatctccaacggtcaaattcatatcatctaataaaaatctcagaccatcatttcccaataagaggttcatatccgtgtaaccataagaagaaattaaatcaataatctcctttatctgatttacagagaaatacttgcgaccggcatcgagtgaaaaaactttggacaaggctagtttttcttgatcaacaataggtttttctggttctgcttcaggatgagtagctacaaaagttacttttgctaactggacatcactggcttgcaagcctttctctgttccatcttccaacttataggaaatacctttaaccgttggaaagacgatcttcacaaatttagtaccttttcgaatgttgcgaatatcaaatgtagtgcgtgcataagctggggttgcttctacaaaattatccactacagtaacattctctttattccagcttttgccgtcaacagatgaatacacagtgaagtcaatttcaccgtcttttgcatttatcaaatgtttgcgaacagattttccttcattagcccctgcttctttattatagacagaatagtcttcaagtgttttgtaataagtcgttaagtgcaaagcctctggattagcaatcttgtagactagtgcattttcgccatcaccatcagcatagagcctgcttgtttcgtaacgtggttgacctccatagtagaaattatttttgttttcatgagctgctttcccgttagagactgttacgaggtgaccaagtttttgctgcggcttaataacataatcattaggcttggcatcatctagattatcaaaacgtaccttactttgatctgctttttgataaattcgaacccaatcaaccaagtactcactatcctgtttagtcatgttgcgtttgtaatcaacatcaccaacccagccatcaccaacttgggtttccagtatcgggaacatagggcgggtgtgcataccatcccgatccttaccacggtctgtttgaaaaacaaattttccatcaatataccatttgatgacatctggagtccattcgacttcgtagacatggaattcctgactccaagcttcgtaattcttataagctgagccatcagattttttattttttgccaaaataccaaaatggttagttgtccatgcataccatggattttgaccaaggtattccaaaacgtcaatttcgtcatgcccggtctcatcctgtgccaacatccaaatagcaggccagattcccttagagtcatttaccttagctcgaacagccattcgaccaaattggaaagaatacttatctttagattctaggcgaccagaagaccatgttactttatctggtaattctttatcatcataccgatcgtgcccaactgcttcaaccaaagtttttttatccttatggttcgtgctacggatagacaaatagctcttgtcgccatcttttttgatagaaactgctttacgattgtatatagccgcatgattccacatgccatcaataatttgccatttactttcatcaatcttgtcgccattaaattcatcagaccagactaatgtatcgtattcagattttggtggaacatattctggagcagattcgtcataagattttcctcgtcccataatctgaatttctgaatatcgaagaggagtatcatctacgcgcgtacctctaaagcgaacataacgcgctttagagttcttcggagttttaattgttataatctgttccttgtcaatggtgaaattttcattcttatagattgtattataattattaccatcattataatcatcatccaaatctatccggaaattacgatactctccaggagctaactgaaccttgatttcctcaatagtatagacatttctaaattcatattgaagataagctttatcccctattgattcttgagtagtataattctcgtcgaactttccatcgttaatggcttctggattagttggagccttaccatagaaatatggttttttcaatttagcgaggttgactagctcggtttgtggttcttcattcgtaccagcatctgcttcaacctgcgccaagacttctatctcgttaaagagaacgccattactatatcccttccaggaactgtttgtattttggatataatgcccccgtccccaaatacgaatataacgagcattgattggtgctggtaattggatgacttgaggctgtcctttatttgcaattgtttcttctacatctgcctgtttgaaaatgacttctgtggtttcaggagaaaaatctgcacttgtagacaattccactttaacatctttaaaagtagacactgcattgtcataagtattacgatgaatttttacagtatggacgggaacttccttttcaaaatcatactgaacgtaaacatgatcccacttggagtaaccgttatctggttcgccagtttctttaccagcaatgattttggtattgctattggcatcgtcgctactaccgtaagcactcccatcggtagctgcatctggattttttatagaaacagaagggaccgttgataattcagaaaccatctgatgctggctgttggttactggctttttcccttctaccacatttttaccagctacttgtggttcctcctgtttttcttctggagttgaaggttctgtttcagttgatggagtagcttctacaagtggttttgcttcaataacaggtggagtttcattgttgattgctactggttctccctgagatacctcctctgctgcaacagtctgccctgcccataccaaaaaactggtacagatgagaagctgaccaaggatgacttttttcgtaaacttacttgtttcttttttcattatttcctcctataaagtctgcaagtttatcctacctatagccaaaataaagcagtttgtaaacctatttagtctcgtacaagactcaaaattcagtttactggttgatgtgcgatcgcatttctgtcacaaatataacatgtaagcgttttattgtagaatagtccaacttgacttattctatatgcagatggggtctatttctaaaacagcatataataagtcacactttcatatatttttgtccacttcttgtaaacagtgacacatttctctctcatctttttaatgatattcttcataagaaaagcccttagatatttcactaagagcttttaaactgtaatttactattcaatgctgataatggctattccgcagttaggcgatagactgcctcagcataaatatccattgttttatataagtcttctaatggcatgcgttcattttcctgatgctctgtttgttctgtatctgggaaacatgcaccaaaagccacacagtttggcatagtacgagcaaaggtagccccacctgacgagattggctcgcttgtcaaatctcctgtcttatcttgataaacagacatgagcgtagataccagttgactgtctaatggcacatacaaggaagcaaggtagtcgtactcttcataggtcaagccacatgattgcgctttggcttgtaaagtagaaactagggcttctttatccgcagtgacaggaatacgaatgtccaagcgaatttctgatttttttgcgctaatggttagacctgcaatattgaaactgagtgtccctgatggttcatcggtcacatcaccaaaaagcttaaatcctgtggcatcttcaccaactgcattgacgataaagtccaaggctggatgattttcgaaatgttccaaagcctttgccaaacgaacgatggcattgaccccctcggcagcatccttggcgtgccgcgaaataccaagaaccgttacttgatcatctttgatttcataatcaaagcctaattgatctaattccgcaataactccggctaataaatgaccggaatagcttgccttggcaggtactacgttataggcagttccagcttcgatactcagacaagggtgacctggaccatgcaatttggcctgtagtaatcctttttcagcataagtcaaagggaaggaagaatctggcgcaaagcccatagttgccacttcttccaactgattgtagcggttcatacaccgccataaggtctcttcatctgttccaaaaatgaaacgaatccgtttgttaaattggactcccgcatcaagaagtgcttttactgcaaataaggccgccatcgaaggacctttatcatcctgaaccccgcgtccaataatataatctccctctaccacagcctcaaaaggcggcgtctgccattgactaagatcaccagcaggtaccacatctaagtggcaaaggattgctaataattcttcgccttgcccaatttcagcatagccataatagccagcagggtctaaataagttttaaaacccatttttccgtcaaagccaacgtgtgctccagaacatcctgaatcgcttgaccaaatggcgtatctgcctgatgttcttgcaaaacagaaggaaaagcaaccagttcttggatggcttgaatacatgcctcctgatgcgatgactgaataaaacttgttctcattgtgtcccctttcaacataataagatatgatatattttctagcactattctatcataaaaggaaaaactgagccaaattttatctgtattcgtgataaaatctgacccagaatttcgattagaagaatgtcgcaatgaccaaaatagctatggaggcaatcatgatgcctacgattaacttacctacaaatttataccaagtaccaatttcaacacgaccaagtgccaaggctcccattacaatacctgatgttggagctaccaagttcaagagacctgatgcagcttggaaagctgtgataaccaagctcgctggtacatttacaaactcaccaagaggtgccatgatacccatagaagcccctgcaagacctgatgaagatggaatcaagaaggacattggtaggtagaagagatatgtcaaaatgatgaatacttgtgaagacaaaccttgcaatccttcttcacccatgtggagaatagtggcagtaatcataccatcgttcatgatgacttgaataccacgcgcgatagcacaaatcaaagctacgctgaaaatatcagccgcaccgaacatgaaggattttaccaaacgttcttcactcataccataaactaaaccaactacaatccctgcgataccaaagagcattgctccttctgggaagtaccaagtaccaagagcagctgttgaagaaccaatcacttgaccgatgaatggaagaccaatcaaccaatcattaaattgtgtaaagatagtcacacccaaatcttcccatggaataaagctacaaatcatgagaacaaatgttagtacaaatacccagagaacacgtttttgagctggtgataattctgcattcacttcttgagttgctgcgacattaaagtgttgcatgtccgcttcacgttgtttataaaccaaggacttagtcggatcgtttttcactttctcagcatagttggctacaaagagaacccccatcgcgagaatgacaacgaagaagacaaagcgccaaatcataccatccgcaacacttacacctgccgcgtcagaggctacaactgtcgcaaatgggtttacagtagaagccaaacagccgatttgagaacctagcaagatgatggctacaccagtaatactatcaaaaccaaccgccatcataacaggaacaaggagcgggaagaaagccattgtttcttcacccataccataggttgagcctcccaaggcaaacaaaggcatgaggatgtaaatcaacattttttcacgacctttgaagcgttttacaatagaagcaatccctacatcaagtgcacctgtttcgttaactacaccaagaaaggccccaaccatgatgatgaagaatgctacgttaatcgctgcttcagtcgcaccgtgaccaagcatggcacgaactggagccataaaaacatcgtaaatcccttgtggattttgagcaaccttctcataggtaccagccaccaaacgtccggcttcatcaacctgatactgaccagctggaataacccatgtcatcactgccataaaggcaataatgagcatcaatattgtataagacgaaggcaatttaaagccttttttcactttttcgctcatcgcaaaaacctcctataatattttaaaagtttatcccctatttaagggaaattgtatccgtaataaccgtatcaaatatccacctatcttcaagagatgtctatctccttcagtctattatctgaaatcattgcttatagatagatacttgataggaaatggatgagaggggagggagcttagacgcccagaccttcatgtttagattaaagggaacccttgtgggactatcaacacttccactcccctaactccatcaataaataacccgtctagtttaaaaactatatttgcatgcagagtacatcaataaatagaagcctcaacgatacatacagctgcttagcctttgacaatgatagtgccgctatcggattcaatcaaagcgcctaagttttctaatgaggtaatgactgcttttgattgcggcttattgtttacaaaagcaatagctgcttcaactttcggtagcatggaacctggtgcgaattgattttgtttgatatattcttccaattcagccacagtaacggtttctaatttttcttggtctggtttgttgtagttaacaaagacatagtctacacctgtcaagacgataaacaagtctgcatcaaccaattctgccaaacattgagaagcaaagtccttatcgataactgcttccacaccggtcagggtgccatctgcttcttggacaactggaatacctccgcctccagctgctacgacaacttcacctgcattgagaagggtacgaatggtaccaatttctttgattcctacaggttttggcgaagcaacgactttacgccagccacgaccggcatcttctttgaaggttgcaccagtcttttctgcttctgctttcgcttcttcttctgtatagaatggtccaatcggcttggtcaaattttcgaaggcgggatcattcttatctacgataacctgggtcacaacagatgctacatctttttcaatgccttccttgagcaattcattttccaaggcattttgcaaccagaaaccaatcgaaccttctgtcatggctaccaaactgtctagtggaaaagctgggttcttttccgaatcagcagcaaggttttgaagaagtaagtttccaacctgaggaccattaccatgcgtgataataaggtcatccccattttttatcaattttacaaggtgcttggctgtttgtaccaaggcctctttttgtgctttagccgatgggtcggacgataaaatggcattgccacccaaggctactacaattttacgatttgccatatctcttgctttttcctcactttcgcgaaatagtaatcgcttacacatctatcctcaaaataagggggctgggtgccagcccccggaggttgcgatgcgttattagatagttaattattacacacgtggaacaaatggatcccctaaagtagccgccatcactgctttaatagtgtgcatacggttttcagcttggtcgaagtgacgagcatacttgctacggaatacttcgtctgttacttccatttcttctacaccgaatttttcagcgacatctttaccataaacagtgtttgtatcatggaaggcaggcaagcagtgcaagaagatgagattttcattttctgcttttttcaccaattccatattcacttggtatggcttcaagagggcaacgcgttcagcaaatttatcttcttcacccattgatacccaaacgtctgtatagagaacatctgcgcctttgactgcttcgtcagcattgtcagtaatgagaacacgtgctccactttctttcgcaaaaccttcagccaaggcaactacttcttcttctgggaagagttcttttggagagaagatatggacattgacaccaaggatagcgcctgttaccaaaagtgagttagcaacattgttacggccatcaccacagtaaaccagagtcaagccttccaacttgccaaagttttctttgacagtcaagtagtccgccaacatttgagttgggtgccatgcatctgtcaaaccattccatactggcacaccggagaattctgccaattcttccaccattttttgactgaaaccacggaattcaataccgtcgaacatacgtcccaaaactttagcagtatcttctgtagattctttcttaccaagttggatgtcatttgcaccaagatattctggatgggcaccaaggtcaatagatgctactgtgaaggcagcacgagtacgtgttgatgttttttcaaacaagagagcaatatttttaccttccaaataacggtgtggaatattgcgttttttcaaatctttcaaatgagctgagaaatcaatcaaccattccaattctgcgcgtgtgaaatctttctctgcaaggaaatgtctacctttaaatacgtttgtcattgtctcttctcctaatgtttaaataaattttgtcaatgtctggcaccattctccatcttcttgataaacttcagaagttgcttggtagccaactgactcataaaaagtctttgcagttaactccgaatgtatattcaactgatgaaagcctgcttcacgtgcatacgcttccaaagagctgataatcatttttccatagccttttccacgaaaattcggtagagtggctattcgggttagacgagcttgaccaggaccgacaggaagaaaacgtcccgttgaaacaggctcttcaccaataaagagattggcgtaaactctttcttccgtatcattctggtcaaattcatcttcctttgcaataccacgctcaaggacaaataccttatagcggacatagatagaggctgcgcgttgccattcttccgaaccgattgttgttcgttctatacttggcattagatgtcttcacgttcaaacggcattgacatacaacgaggtccaccacgaccgcgaaccaattcgcttccgccaatcttaatcaaacgaagccctttggactcgaggatagcattggtaatcgtattgcgtttgtaaacaactaccacacctggtgcaatagtcaatgtatttgaaccatcattccattgctcacgaccagcagcaaccatatcaccgccaccacaacgaatcaattctactttttcaagaccaaggttcgcagccaaaagttctgccaaatcaccatgttcttcttcaatatgaagcgtgtcattttcataggttacagagaagacacgaaggtcaccttcgatttctgggtggatagtaaacttatcatagtcaaccatggtaaatactgtatccaaatgcatgaatttacggttgttagcaaattcgaatgccaatactttcttgaagccaacatgccgttcaaagatatttaccaatagtttttcaattgatgccgcatcggtacgttgtgaaatacctactgccaaaacatcttttgaaagaaccaattcgtcaccaccctctatacgagtagtttcttcacgattgtaaaccaatggaacttttccaccatattctgggtgatgagtgaagatatatttaccatacaaggtttcacggttccgtgtttctgaatacatgtggttaagagaaacagcattaccaatcgtagcaaatggatcccgtgtgaagtaaaggtttggcattgggtctattgcaaatgggtaagaggattcaaccaaatctgtcaaacctttttcttcagaagggatttctggcaattctgccttttgaacaccagccatcgttttctcaaccagttcttgattatcttcaatagacatcaacagcttacgaattgcctttttagttgcccggccacgaatgttagcttcttcaagatattcatcaataaattgttcacgaatttcaggtgtaacaagtgactcagcagctaatttttccaagtagagcacttctacaccttcatcacgaagagcttgagcaaaggcatcatgctctttctgtgcatcttctaagaatgggatatcatcgaagagtaggcgttctagatagtcaggcataaggttttcaatttccttacctggtctgtgtaacataacttttttcagcttaccaatttctgaaaaaacatgaattggatggtttgacatgatctgtcctccttgtagatttatacatgatgggaaacgaggaggaccgtacgctttcctgcctctcatttcctctttacatccatagtttaacagagcaaaaaaacaaaaacttgaaaacgctcacatttattttgagaaattcttcacatttttaaccttatttataaataattatcgattatatcatctaaattctgcataattctttccgttatatcattatatgaatttttatttttttataaaaaacagaaacttcaatgagtttctgtcaaattttctaagaaataatcaatatctaaataagttaactgtttatggctataagctattttaccatcctgcttcagttgcttcaaaacatggctaaccgtttcccgtgtcgtagctgctaaacgcgaaatctcttgaatatgaatttcaaatggcaaggtagcaaactgctctcgctggcacatatcccaataaagaagagccaaggcttgaacgactcgatctgatgccttggaacgcatcgcatttcgcaagcgcaactcttgaaaacgaagcactttggataatttttgacagatataagccatttgactcggatttatcttcgacaaggtttcaaacaagaccatcggtacaataaaatactctaggtccgttatggcaatggcggtataatgataaggtttgtcctgaaacatatctccaaaaggaaaggcaccaccctgccgaatatagtctaaatacgtaaaactatccgtctcatcatattgctcaatccgagcatagcccttatacaatacaaatagataatctctaggatcctctgcgtaaaaaaagatttgtcccttaggaatctttcgaaaacgaatatgcttagctaattgatcaaagctatcacgtgtcaaacgttcaaaagttggatgtgcccttagataatcatattgttcgttgcttatcatcaaaactcctttctagctaaagtatccttctatccattttaacatatattaacgttctatgctaatcattactgaaaaattcataaaacaggatcattcctgtgaagaggaatactatcacaactaatacaaaaaactggtcctctcgaaccagtcttagtatcgtcgaatgaattaactttcagacaaggaactgaggtgtaagcaatactagagtacggcaagccgaaagtaacgatgtatcaaagttaattcaaatgtccataacattctatgtatacctatctagtcagtcaattcatccgcaatcttattgattttccgcaaacgatggttgacaccacttttagtgatcggtaccgttagactatccgccaattgctgaatggaatagtctggatgctgaattcgcaactgggcaatctcctgcaagtcacctgacaactgatctagaccgatagtatccataattttgataatattattgattgttttcatactagcattgaccgtctttgcaatattagcagcttccgcattggtagctcgatttaggtcattgcgagcctcacgaagcaatttaacattctcaaattctgtcttcgtctcttctgctccaatcaccaaaagaaaatccataatgtcctctgcacgttgcagataggtaatggttcccttacttcgctcaatgactttggcatccaaaagaaatttctgcatcagattggccaggtcattggcatggtcactatagacagaagctatttcaagctggtattttcctttttcaggatccttaacagagcctgccgctaaaaatgctccacgaagataggcttgactccacgaatcattttccaaaaccaagggagaaatccccgtctctaatccaaagaagctatcagccaaatgcaaatcgttcaatatctcattcacgccgtcttctatcaaaactgcatacacacgattctttttgagattaggtttttgatgatggcgaatctcagctttaatctggtagaaatggagtaacagttcataaatgtgacgggcaatctttgcattttccgtgctgatagaaagagtcaaacctgatgaagctaagcccaaactacctgataatttgataatagcagatagctcgctcttattttggctagactgaagcagcaattcttcctttacttgtactgtaaaactcatggccgcacctgcaaaatcttgagcaactcttctactaccaagtcaccatcatggaaagctccgccattttccaaacgaagaaaattcgaagaaatcacacgattagcttgtttttgcaaacctgcaaaatcgtgttttacctgtaccaagtattcatcaaactggttgctattcatatactcttgtggaactggctcaatattgaccaaaactgtatcaatgaattgttcagctaagtgtgcattgagaaccgccacgtggtccgcatctgagaaaaactcagtctctccccgttgggtcataatgttgcacacataggtcacttcagccttggtttcttttagggctttgccaatgtcagaaatcatcagattcggcaagattgaggtaaaaagagaacccggtccaagtacaatcatgtcactttccataatcgtttcaactacctggcgactggctttcggttcatcatcattataagaatttgtcacatagacatgatcaatcatcccattatgcttggaaatcttactctcacctgctacctcggtcccatctgtaaaaatagcatgaagggtcaaggcctgttcgctagatggataaatccgccctgtcgtatggaaaaagcgcgtcaacaacctcatcgcattgtaggttgaaccctgcatttctgaaataccagcaatgatgagattccctagtggatgaccagccaaggggccatctgaatccgcaaaacgatactggaaaatttgttcataaagtttgggcatatccgacatagccaataggacgttacgcaaatcacctggaggggtcacctgcaaagcctgacggatttcccccgaagatcctccgtcatcagctaccgtcacgatagcggtaatctctacatccttatcccgcaaactcttcaaaatgactggaataccagtcccgcccccgataactgtaatctttggttttctcatgagcggttgaccgtctccttccgtctgtccttatcacgatgactacgattaacattccaatttttctctaaatcgtctgccaaacgtttagcaaaggctacgcttctatgctgaccacccgtacatccaacggcaatcgttagaactgattttccttctttctgataaccaggaagaatcggttctatcaagccgagcaaatgactataaaactcttccgattcttgatgctccatgacatagtcaaagacaggagcatccagaccagtcagattacgcaactccaacttgtagtagggatttggtaagaaccgaacgtcaaaaaccaagtctgcatccagaggtagtccatatttgaaaccaaaggacatcacttctatgcgaaacgacggctgattatcttgactagcaaactgctctgagattaccttacggagattgcgaggtgtcagctctgtcgtatcaatgacattctgactcatatttttcaagggagccaaaagttcacgttctagctgaatcccgtccaaaacacgaccatcagccgccaaaggatgggaacgacgagtttctttatagcgagcaaccaattcactatccgtcgcatccaagaataggactttaaaatctaaatcctctgccccctcaatctcatccaacacctctcgaatctccgagaagaaggatcgactccgcatatctacaacaagagcaatcttattgttatcctggctatgacgaatcaactctaaaaactttggcaagagagtcggtggcatattgtcaatggtaaaataacccaagtcctcaaaagactgaatggctactgtcttaccagctcccgacatccctgtcacaatcactaaatggagtttgtccgacatgacatcccctccttttctcttctaatcaataactgcaataacttcaatctcaaccttaacatcacgtggcaagcgtgcaacttccaccgctgaacgagctggaaaatctgctgagaaagctgttttataaacttcattaaaggctacaaaatcattcatatcttttaggaaacaagtcgtcttcaccacatggtcaaagtctgttcctgcttctgataaaattgctgcgatatttttcaagacttgctcagtctgctcctgaatggtttcaccaaccacttcaccagtttcaggtgacaaaggaacttgaccagaggcaaataggaaatttccaacaaccttcccttgaacgtatgggccaattgctgcaggtgccttatctgtgtgaatggttttcatctgattatctcctttttatcattctactgatattataccaaaaaactagcctattcagccagttttcgtgtttgcacaataaacctccaagtcagaaaaatcgctcgcaagagcaggtcaatcaaaatcgacagccagacgccggcaattcctaaaccgaacatctgacctaagacgataacacctgagacgcgcagcccccacattcctatcattgtggagtagagtggcgacttggtatcccccaagccctgcagagcgccagccatgatcaaagaaaccgcaaggcctggctggttgaaagcatcgatccgtaaggctgtgacgacttgacggacggcttctaggtctttggtaaatagcagagcaaaacttggggctccgaaaaataagatggtaccgagcagggacatgatggctactccataggcagagctgagaaatgcgacccgtctaactgtgaggatgtccccctttcccaaggcttgaccgatcaaaaccgccgccgctgtcgcaagaccataggcaggcatataggtaaaactctcgatattacctgcaatcatatgagaagcatagacaatcgttcccagccccacaatcaaactgaaatagacaacctgtcccaaccgcataaccaagcgttcggttgctgcaggtagggtcaaaaccaccatttccttaggacttcccaagtggaacaattgtttgagatcaactgccaagtcagtctgctgtacctttcggtaaagcaagacagtaccaagcaagcgagctaagacagttcccaaggcggtccctacaatacccaaacctgaccaagagccaataccaaaaatcaagaaatagtccaagaccacattaaaaccattggtcagtaagctcattttcataggaaatactgtatccccagatgcccgcaggattgttcccaaaatagtcatcaaggcctgaaaaatagtcaaaccaccaacccagtagaaaaagacctggacgccagccaaactctccgcatctgctcccattaagaccaacatctgccgcccgaaaacaagggatagtaaccccaatagcagacctacacctactgaaagcactaaggcttgacggacatgaaaggtaagagattccctatctcctgcgccaatagaccgagcaatcaaagctgttgccccaactcccaaagccatatagaccgccaaatagacattcaaaatcgtattggcaagaccaactgctgtcaccgctaccagccccagctgtgcaatcaagagggtatccacaaaaccaactaaggtctgaaagatattttccaccgtagcaggcaaggccaaacgaataatttcttttcctaaactttcttgcttcattttcctctccacgattttatttagaataattataaataaaactcagtgaaaaagaaagaaaacagggagtggggaagaactcgataagtcaaaaaggagttcatctctccacccccgcatagctccaaagtttcagggaacctttggaggttagagataaggcgaacaaagttcgcatcagtcgtataggtcagatttggagtggaaaacacgaattgctgagatttgcttcgcaaaccttatctccaacctttttacctagcttttctgcttcaagactcgggctgaaacagttcccagaactgcttcactccactggactgttaaagccaatcaaccactgcgctgagatgttgacacgaactctgagaagtacaccgataccgagcctagttacctagaacttcattttttatagatttctttccggtgcccgatttcaagggccaggatgaccattttgttatcaataatatcacaaattacacggtaattccccactctataccgccacagccccttatagtctcctaccaaggccttcccaaattgtcttggattctccaaaccgtccaaacgttttttcaaatccttagcaagcatcatccccacatgcctgtccatttttttcaactgcttcaaagcatcatcgctgagaacaagcttataagccatcttctaactccgcaagaacatcatcaatcgagtgtgtaacaggattttcttggaatttcttcaaagccttgataccaatttcatagtccaactggtcttctatctgttcagcaagtgcagttttgaatagctcagacaggctttttcctgtatgaatagcatagcttctgaaaatttcttcttctgcatcgtttaatcgcaaggatacaattcccatcattccacctactttcttcttgtaatacattgtaaaacaattcgttcaaaatgtcaattgacaccagaaaaacagaccacgtttgtagtctgtcagtgaatatttatttcgcagtctttcagtttacttttagtactaggcaacgagctgcagactgtactaaggtacggcaaaacgagttcaaataatgatgagattatttgaacttggaaataaggaaacggagtttcctcatacgtcgacgtaataaaggaaaaactgaacgactgtattacggatgcaagcggtgcaacatacgtgggaatggaatggcttcacggatgtgttttgtaccagcaacgaaggttaccatacgctcaataccgataccgaaaccaccgtgtggcactgaaccgtatttacgaaggtcaaggtaaaattcgtactctgacttgtccataccgagctcgtccatcttggataccaaggcatcgtagttatcctcacgcatagaaccaccaatgatttcaccatagccttctggtgccaagaggtccgcacaaagcacgcgctctggattacctggaactggcttcatgtagaaggccttgaagcttgctggatagttaacaacgaaagtcggtacaccaaagtagtttgaaatccaagtttcatgtggtgatccaaagtcatcaccatgctcgatgtgttcgtagtctgtatctttatcagcttcatgctcttgaagaagggtaatagcatcatcataagccacacgtttgaatggctctgcaatgtagcgtttgagagcatccacatcacgctcaagagtttccaaggcttgtggagcacggtcgataacaccttgaatcaaggctttgacataagcttcttgcaagtcaagtgactcttcatggctgaggaatgaatactcggcatccatcatccagaactccgtcaagtgacggcgagtttttgatttttccgcacggaaaacaggaccgaagtcgaaaacacgaccaagggccatggcaccagcttccaggtaaagctgaccagattggctgaggtaggcaagctgaccaaagtagtctgtttcaaacaattctgtcgaatcttctgccgcatttccagacaagattgggctatcaaacttgataaagccattcttttcaaagaattcataagtcgcatagatgatggcgttacggatttgctggatagcgacctgtttacgagaacgcaaccagaggtgacggttgtccataaggaagtccgtaccgtgttcttttggtgtgattgggtaatcttgtgactcaccaatcacttcaaggtctgtcacatccaactcataaccaaacttagaacgctcatcttccttgacaatccctgtcacatagacagacgtttcttggctaaggcgttttgctacatcaaacttctcagtaccagcttcttcaccgaatttttcgatgaagtttggtttgaaggcaactgcttggaagaaggctgttccgtcacgcaattgcaggaaggctaacttgcccttgcctgatttgttagcaacccaggcaccaatggtcacttcttgaccgacataatcttttacttggttgatggtaatcaattttctagacattatttttcctctttttattttttcataaatgtgtgtagtcgagccactgcttctttgagcgtgtccatatctgtcgcatagctgaggcggatattctcaggagctccaaaaccagcacctgtcaccattgcaactcccacttcttccaaaatggctgtggtaaattcagttacatctgtgtagcccttcatttccatagcctttttgacatttgggaagagatagaaggcaccttctggcttaatcacttcaaaaccaggcacttctgccagcaagggataaatggtattgagtcgctcttcaaatgcctgacgcatggtttcgaccgtatcttgcggacctgtaaaggcttcaatggccgcatactgagcagcggttgttaagtttgacgtcgtttgtccgacaatcttactcatagccgcaatgatctcaggattaccaacggcaaatccaacccgccaacctgtcatggcataggccttggccaccccattgacaacaatagtctgctgacgaatgctttctgaaatgcttgaaatcggtgtgaaggtatttccattatataccaaacgaccgtaaatatcgtctgccaagatgagaatgtcgtgctctacagcccagttgccaatagcttccaattcctcacgactgtaaatcatgccagtcggattagaaggagtattgagtaggaatactttggtcttatctgtccgagctgcttccagctggtcaactgttaccttgaaattgtgctcttcacttgcagtgacaaagacaggcaccccatcattcatcttgatttgatctgcataagaaacccagtaaggtgtgggaatcagaacctcatcaccaggattgatgaccgccgcaaagaaagcataaaggataaacttggcaccagtggcaagaacgacttgattgcgttcgatagagtagccataaaagttctcaaagtaggtattgaccgcgtccttcaattctggcagacctgaagctaccgtataaaaactcgccttaccatcttcgatagacttaatagcagcttcttgaatatttttcggtgtaacgaagtctggctcacccaaggtcagctctaaaatatcacgtccttctgccttcaaggcctttgcccgtgcacccgctgccagcgtgacactttcttccatttctaagacacgttttgatagcttgctcataagccctcccgtttgataaagttccctgtttcaaattcaactaaatagtaggcagtacctgacttgacttcccaaataggtttgccatcccttaaacctagaatagttcgctctacttggcttgcaccgtttttcttggcaatagcttgcgcttcttcttgcgaaattccctgagctaaagaatagacatatactgtgctagaagcctctggaatcaaaactgcaacctcttctccctgactggtgacaccaaatacacaaaaataggtttcagtaccattgtagatagaaaaatcattgacagtttgcaaatcagcatattctgtagctactccaactgcatgactacgcgcattgttgaaaggggcagcagcaatatcccaaatagtaaaaattgaaaaagtcacaacactgagaaggataaaagagcccatcactaactgaccagtcttggaagccatccactccaacagttgaaaaatctttttttccataacagtcccattatactacaaattaaagcatatttccattctttctgtgattgtatagtcaactgaaacaagagcaggacgaaagtgcctcaagaaaagtatcgcaatttggcaatactcttctgaggtgttttttgatgtgagcccatattttctcaatgggattatattccggtgagtaaggaggaagtggtaaaagtctatgtccctgctcctcgcataaatcttttagcttactcatcctatgaaactttgcattgtccataatgataacagatggtttacctaaagtgggtagtaagaatgttttgaaccaagcttcgaaaaagccactcgtcatagtatctttgtatgtcatcggggctataagcgcaccatttatgagacctgctactaaagatatccgctggtatcttcttccagagaccttaccttttatcaactgacctttcaaagagcgaccatattttcgatgaaaatatgtctcaaaccctgtctcgtcaatataaacaggagtcaagtggcttaagttattcaattctttaaggaacagttctactttttcagggtcttgttcatagtaggtacagctcttttttttcgagtatatcccatagctttgagggggtaatgaatagctgttggatgacagtcaaattcagaagctatttcagtcaaataagcatctggatgagtttcaagataattctttaatttatctctatccacttttcttggcttggttcctttaacttggtgatgaagctcgccggttttctcttttaattttagccattgatagatagtgttacgtgaaacttggaaaatagctgatgcttcagtaatactgccggttttctcacagtatgcgagaacttttttacgaaaatctaatgaatatgccataaatacattatatcataaatgtactgtttttgtttcatttaactataaataaaatttccttttccttcacacaaagaaaaggatataaaaacctacattcacagttttgcacttccatctaagactatttctcaaatgctcattgctcgttttttccagtacagttagtattacctcaaaaaacgaacttgattaactaaaaactatcttttccataaaagtactttacctatgaatataggatttaactttttttgcttgataaccgaacgatttattgctaaaatattctcatgagaactgttgaacaatctttaaacgagaacaagcatgcacttcacagtctagtcgtctttcgcagagcagctaatactatcgcaaaatcagaattagaaacaatcaaaaaatacggactgacagtttgtcagtttggagtgatggaggcactctacaacaaaggaaatctgcggattcaagacttaattgataaattattaagcacttctggcaacatgactgtcgttataaagaacatgattcgagatggttatatctacaagactatcgatacaaatgaccgtcgtgcttccttgattgctctcactccacttggacgcgaaaccattgaaaaaatccttccagagcattatgatcacgttggagagattttttctgtccttagttcagaagaacaagaccaattagccgagatacttaaaaaattcaagaatcagcagacctaggattgtcaacaaaagacaaatacgatatactaaatttatgtttttatgaaaaggaggccatcatggcaaacgtattgtttttagttggttcactacgtgacggttcttttaaccatcaaatggcaaaaaaagctgaagcattcttgactgataaggctcaagtatcttacattgatcttgcaaaaattcccctattcaaccaagacatcgagacacctatccttcctgaaattgcagagctacgtgcacaagtagacgctgcggatgctatctggattttctcaccagtatataactatgcaatcccaggcatcgtaaaaaatgctctcgattggctcagtcgttcgctcgatttatccaatccaaaaggaccatctatcctacaagataaaatcacaactgtctctgcagtcgcaaacagtggtcacgaccacctattcaaagacttccaacaccttcttccatttattcgcactcagattgctggtgaatttacaggttcaaccatcaatccagaagcatggggaacaggtgtattggagttatctgacgaaactctaacaaaactcgaacaacaagtagctgacctgttggcagcaattcaataataatcaaaaaaaaccagaatttctggtttttttgattaacattttaagagcattccgacttctgccaagaataattactactttgatgacttctcaaaatcattccccaacttcatttctcacacactgtaaggcagctccgatgacttggtgcatatcgtagtaacgataatgaccaagacgcccaccgaatatgacattctcttgttgttctgacaatttcttatatgctgtgtatagatggttattgcgattattgttgactggatagtatggctcatcgcctcgtttccaggtcttcgaatactcacgtgtaataatggttttcggttgtgtaccaaattcgaagtgtttgtgttcgatgattcgagtatatggtgtctcgctatctgtatagttgacaaccgcattcccttgatagttttccatatccaacacttctgtctcaaatcgaaggctacggtactccaattcaccaagttggtaatcaaagaactcgtcaatcattcctgtaaagacaatctttggataggtagctaaatagtcttccttattggcaaagaaatcaacatttgtctccacatcgatattttcatgttccaacattttttctacaatctgcgtgtaaccgccgattggaataccttgataagtatcgttaaagtagttattatcataagtcaaacgcacgggcaaacgacggatgatgaaggctggtaactccgtacatggtttttcccattgtttttctgtgtaggacttgatcaatttttcatagatgtctgtaccaacaagtgagatggcttgctcttccaagttttcaggcgttttaccacccaacacagctcgttgctctgcaatcttcgctcctgcttcagcaggtgtcaccacgccccacagtttattgaaagtattcatgttgaagggaagattgtaaatctcacctttgtagttggcgactggtgtgtttgtatagctgttgaactccgcaaactgattcacataatcccaaatttctttttcagaagtatggaaaatatgtgcgccatattcatggacttgaataccttctacttcttttgtatagatgttacccgcaatgtggtctcgtttttcgataacctttatttttttaccctttttagctgcctcatgagcaaagaccgctccgaacagacccgctccgacaactagataatcgtattttttcatattgtttttacatttaactttctaaggaagtcatttctccaaatcttttactagactatcattaataccatcgtctcataactaataaagaatgagttgtgataatctcttccctaaaacctttcacttaaagcttgcaatatccaatattataacagacaatacaaccttcatcaagtttagcaatagacttgttcggtaactcaaaggcggtatactaaaggtatggaaacaacatacgaaaaagtcttaaaattaaactcagagaatttcaaattgttgataggtgtaaaaaagcgacgtttcatctgatgcttgattgtctcactgacgcttatcaagagcaacaccgaaaaggaggacgcccacgccgtctaagtatggaagagcagcttatcatgaccttgcgctacttacgctattacccgactcaacgcttgttggcatttgattttggtgtaggtgtggcaactgtcaacatgatgcgtatttgagagttcaaaggtcctggggtcctttgaagctgcttgccaaaaaacaggagagcatactggacaatctaattgcgtttttctaataatcccacaacttctatgtgatgcgtatttggaaataaatcagccggctgtaccttcgtcaatttgtaccccaattcctcataaagtttaatatcacgcgccatggttgccacattacaagagatatagacgattttctctggttttacagaagtacttgctttgataaaactttctgtcaaaccttttcgtggtgggtcgacaaaaatcacagttggtttgactccatctgccacccatttttgcatagcggattcagcgctatcacagacataagtaacattatcaatcccatttcgagcagcattcttctgactatcaaggacagccttttcaacgacttctacaccgtaaacatgcttaacttgttttgcaaaggagagaccaattgtcccaatacctgaataggcatcaatcacgacatcatctgccgacaattctgcaaaatcaatggcggtctgatagagtttttcagccatttctgtgttgacttgatagaaagacggtgcagaaatttcaaattcattgcccaacatggtatctgcaatagtttcactgccatgcaaaagacggaattcttgaccgaatatagcattggtattctggtcattaatattctgaacgatagaaacaagatttggaaattggcttgtcaaacgctcaataagggtttcaacacggaaaatcttcggacgagtcgtaactaaaactagcatcaactgacctgaataatgaccacgacgaacaacaatatttctcacaagtcctgtctgttctttctcatcgtaaggcttcaagtctaattttctcaagaggtcacgtgtcgctagaaccaaggcatcaatttccttgtgttgaatgtaaaaatcctcaatcggaactaaatcatgtgaattttttcggaagaatcctgtttctaactgcccattcacacgacgaactggaacagctgccttattacgataagcaagaggactgtccattcccaacgtatctgctactgctatttctgaaatgcctgcaatcttacgtagactattctcaacttgttttttcttaaaagctagttgggctggataagtgagatgccccaagtcagcaatacctgttcttagataggtaaaatccaagtcctgattacggtcttgtgagaagctctgccattgctccaccttaccaaaaccaatatttttcttaagttttaagatgcgcatggaaattttctcgcctggaagagcattgtctacaaagaagacaaaaccatcaatttttgccacaccctgcccctcatgtgtcaaatctacaacttctacttcgacaatatcgtttttctttaacataattctactttctatttttggaccactaaaaagtgaccgaagtcacttctagtataccatatttcttaacgcaggcctaactcagccaagcgctgctggtatttttcaaaatcaacacgaagagccataccaccatacatatcatagtcgtcaatccagtctccattttctgggattgtaacacgttcgataccatttgccgcatccaatagaaggcctggtccctgtagccacataaagctttgcggtactgttgtcggagtcatggccacaaccttacctatagcttcggagccagagaatagtttcattggatttttagcctgtgtcataacagcagatagcacttcctgttgacgtctcgtacgaccaaaatcaccttcatcatccgaacgatagcgcgcgtagttaagcaaggtcttaccatccatctgctgtacaccgacctgaatcgtttgataagcaggagcattttcttccagctgtaaatcattcggcacttctactgagctaacgacttcaccattaatagttgaaaactgtgcatcaatcgttacgccctcagggaaaagtgtatcaatcgttgtcgcaaaggttgcaaaatccaccatcgcatagtacttgatatcaatgtcaaaactattcttcaacgccttccgaacttcttcagccccttgctgattatcctgttctcccaaagtataggcagtattgagtttatattcatatccctcaatatccaccaaggtatcccgcataaagctaacaagtttgactttgttatccgtgttattcacatttagaaccatgatggtatccgttcgagtttcacctgagctttcgccaacacgaccgtctgttcccaaaattaaaatatttgtcccattcgatgtatctacgccgttgaagacctcagctactggcttctcactcacgctattcatacctttgaaaaaactatagcccatcgctacaatcactagcgctatagcaagcaatacgaaaccaataaagcgcttgaaaccaccctttttacgagcttttttaggtttaggtactttcgctttgggaccgatacgaggagactgaaaccgttgaggtttggcttgtcttgtttttctggatttacgttcaggatagcgaggcaacagttcctcttgctcatcatcctcttcaaaataatcttcctcgaagtagtcatcttcataagccgttggtgtgaagctacgtagagattgccttggacttccatgccgttctctcagctcttttttatataatagataatccaactcgcgactttctttgtcatttaagtagtggatatttttttgcaaataatctaacctcaattgttcatgatgggttaggatattattgtttttattcatctgtcttcatcctagctggtcatatagaccaggtaattccctagtactttataggttatatctaaactagtcaattctttttgagaataggttaataattcctcagactgattgtcaagatccagtatgaaaaaatactcacccaaagccgttttcaggggtcggctttctatttttgttaagctgattcctctccatgagaaaacagacatggccttatacaaggctcctggcaggttatctggcaatgtcagtgcaagactgacttttttagctacttgttccagggcaatagacggagccttatcccccaaaatccaaaagcgtgtaaaattctcgctgatttcctggatgtcttgcgcaattacttccagtccatattcaactgctgccgcttgcggagcaattgccgcaaatggttgttcagggtgttctgccacaaagcgagcagcataggctgtactaactgttatttcaatacgagcctgaggaaaatgttcctgaatatatttcttcccctgagcaattgcctgcggatgagaatagataacctctacagccttatcggcactcgtggctaacagttgttgggcaatcggttgaacaatctctgcaaccgcatgaatctccgcctgatgaaagaggtagtcaatcgtttcatgaacactaccttcaatcgagttttctactggaataacggaataggtaacttcccccgtttcgtaggccttgataacctctgtaatcgtctcaaaagcctgcaaatccgcagtcggaaagacctgctgggccacttgatgtgtaaaagaaccacgaggtcctagataggctacttgcataaaattttccttgctacttgttctggaatcagtttatctgtatcgattacagtatcggctaaaccttgataaagtgccattcgttcacgatagagggcttcaaactcttccttactacactgtaaaaagagaggtctttgcgactgtctatccttacgaattctctgataggaaacttcaaaggaggcagtaagaagtacattgtcctccctatttgccaacagcaattccctgtttacttcagatttaatcacaccaccaccagttgatacgatacaattactaggtaagtccagcaatcctttcagtacctctgtctccagttgtctaaacgaagcctctccttcaagactgaaatagtcagcaataggcataccaatccgttcttcaatgatatggtccatatcgtaaacggggagatttaacaaatgtgctgttgttgtttttccaactcccataaatccaagtaaaacgattggcatacgttctcctaatccatcaaactatttaagtgttcaaagaaggcaggatagctagtattgatagcttctgctctttccaatacaacttctccatctttggccaacaaggcggcaatggcagtcatcataccgatacggtggtcaccaaatgtattgatttcagcaccatgtaaagcagttggtccgtgaataatcataccatcttctgttggttcaatagttgctcccatactatttagagcatctgcaacaacctgaatacgatccgtttctttaactttcaactcctcagcatcacgaataatcgttgttccatgtgcttgagtcgctagtaaggtaataatcggcaactcatcaatcaaccgaggaatcaattcgcctgcaatctccgtagccttcaattccgacgtttcaactgtaatggtagcagattttgcaagttcatctatgttagaaagagtcattttaccacccatagctttaatgacatctaaaataccagtccgagtttcattgattcccacattttcaaggacaatttttgaacctggtatgattaagccagcaaccaaccaaaaagcagcacttgaaatatctcctggaactgtaatctcttgggcaataaactcctgaccaccttggatgcggatttccttgccattgacttctaactgtccaccaaactggacaatcatatcttctgtatggtttcgagtcaactctttttctacgatgaccgactctccctcagcctgcaaggcagcaaaaatcagagctgattttacttgagcagaggctacagggagttggtagcgaattggttttaaattcttattccctttgatggtcaacggaggtaggtcacgttcagtttgtccagaaatctctactcccatttgactgagtggaatagttactcggtccataggacgtttggataaggaatcatcaccaaacatagtcgcctcaaagtcttgacctgctaaaacgcctgaaatcaaacgaatcgaggttccagaatttcccatatccaaatcatttttgggggcttgaagaccatcaaagccaacaccgtgtacttcaacaatatcaccattgtcttcaatttttacacccaaatcacgaaagacctgcatggttgacaagacatcttccccacgtaaaatattgtggaaacgggtaacaccttttgcaagggaaccaaaaataatagaacgatgactgattgatttatcacctgggacacgaatcgttccctttagtttttctacgcttcttcttaatttcatatccttacctcaaactagtatcactttcattttatcatatttataaaatattttctgatttttatgacaattacttgtgaaaaatcaatctccattacatttttgaaacaaaaaactaaaaatatttactataaaaattttaataaaatctataaaacaaatgtagattatggtatgctaatgataataaattgttatcggtaggagatcttatgaagcaattgctacagtattatttacaaaattttgataaagagtgctctaagaccaatttatttttagttgctaatttacaaaaacaaactaaaaaaatgtcttattatacaattgaacatgcatctggtcgtgaatttttttcgctatcagaatttgaggaaatagcttcagcactgttaaaaactggtttatgtttgaacattttttatactgaaatagatttcgtggagtatatattaaaatactattagcgcttatcaaaagaaactttgttagtttataatttggctagagacggtcgaaaagaaggaaaaaaatcgctgattccctctttttgcgattactttagcattaattatacaggttcaaatgcactaacagtttcattatgtcgtaataaatttatttggggagctattgcagattactttaatattccaacacccaaaactgtttgtataaaagatggcgaggtattaggtgagccttttgaagctcaaaaatatattagaaaagaaatttcggaatctgcaagtattaatctttccaatgattcaataatgaataattttgagtggaaaaatatagaaaaaaagattttctgttgcaagagtgtatttcaggaattgaagttgaagtcccttttttaatattaaagggaaatatcttgtattagatccagtcaaaattgtctcttcttcagaaattataacaagcaaactatctgataataatagttattcatttgaatggttggaagatcaacaaatatgtacaaaattaaaagagtcaacaaaaaaactcgccaagtacttaggtataaccacttacggacgagttgattttagaataaagtcagatgggagttattttgtttttgatattgcaacaatgccttacacaactgaccatcgttcatttaattttaactttgagcaatatggacttacaatgactgatcttcataaactagtaatattaagtagtttataatgcactagtatactgtatatcagttagcataaggcctcttcgaaagtaattccattctcttgaagcaaacttggattgtgatagaaattcagaaaattcctttcctgtttttatatttgattcgaaaatctttttatagcgacgatgtttttcaattaataattttttatttgaattgaaaataataggtgagaaatcttttaattgattgtatttattttttgcttgtcgatgcttactctctagtaacaacaagcaaaattcaaaccatccaaaataataacgataaaaatcatctattgaggtatcttcaaggtcggctaagtcctcaacatccatcaattcttcaagtatcgttttatagcttctgtacccttttgttttagaataatatagagaaattgcacataaatttgtatacattaagtgtttactcacatcatttaactcatattcagtaagaatgctttcaaaccgagatttccaataatcaaaatctccttccatacctgaaagaaagtccagtacaacaaaattatttttagatttccagtatagtgggagattgtgtttatctgatagtgtttctatttcttgtttcacctgatttgctcgctcatagttggaagaaacaagtaataatcctagaagactaccaagtgtataatactgttcaatttcatcatcgacatcgttaaaaaattttaaagctttattggcatcattgattgatctatcattatccttgtataaaaaactttttcttaaatatatattttcaagatattgtgcattttgctcaatatcttttgttgtataaaattttttgacaatattttcatttaaaacttggaatttatcaatttcattaagtttatctatattaagtttatctattaaatgaggtaatagcatgtaaatacatgaaagatagtgaataggctcaacaataacatctttggcgctttcagctaatatattttcgtaaagtgtatcacaaagtgaatgaaaagaaaaatcttgtgatgtatttccttgaaagttaatatcattctttaataatatcgaagataataatgaattttcgggtaaaatttcattataaagagagttagtaccatttgtatatttgtatttgatacatttaaaaaatattgatttagtctcttcagtgagaaattcaagtttatataaactctttttttcgctttctagtatctcgttttgatttaataaatattcataccagagtaagtatagtgataataaatattcttgactctctttaagtcttgataagatttctatctttaatctgtaattaaatggctcctttccgcatagataatgatagtaccgtctatagatttctttttgtcctttttcaaccgttaaaagaagcttatctttcataatcaatatcagactataaaaatttgttctattttttacaggaatcaagactagtaatttttttaagatatcaatagctttttcaatttgaaaagtttttaaattaaagtattcttcggcatcatacgggttgaaatattcaggaaggactgatagctgataaatgaaatcaatttcaattttattctttctaaagtctatttcaatcgtatttaacaaatcatctaataacttttcaatcttagaattattctgtgatagtaaaataaaattataaattttttccaagtttccctttgttagaggatacagtgtatcctctaagttatcagagatgtttgaagtttgtataatattacctaaagtatcttttaaatcgtttaattcaaaatgatgaacatcaaagttttttgaaaatctaatatcattattttttaactccgagcctccaattacaataataatcgatttattatattgcttttcataatgggagatattattgagaaggcgtataaaaaataattttagttcactccctagccactcccaatgttggattagaaatattaatctgtaattgttgctattatttagtattttcttctctatctcagttgaatcatattttaatgacagaccagctgttccaaatccttgtatcgagttattaacagatactgaaataggcttgaaaaatttttctgcaaatgaaagtttatactcgtctgtaatattgttatctccgaaatcactatacaatactgtaccattcccgtcaatttcgctttccaatagttcctgtgatattgtatcaaatgctaaggattttgataaagaatcttcgaacgggatatatagtgaaagtgacttttgatctgtatgtgcttgaataattgaataagtaatttctgttaaaaattgattccaatgagatataattaaactttcctaccgataacaatttattatcattagtaaattgataaattatcgtatataatagctttattacgacatattaaggagattatattatgaattacgacactatccagagatatcttgacttttgtgctattcaaagacgacttagttctcatactatccaagcatacaaatccaatttacattggtattatagctttaggaccaatgatattaggtcctatcttacttttctcaaccaacatataaaaaagactagcacattaaaacgtaagattgctagtcttaaatcatactataaatttctggaagaagaaaaactaatttcaaaaaatcccttccatcagcttcgactccactacaaggaagagaaaaagcttcctaaaacgatttccttgaaagatttacaaaaaatatattgtttcgcccaccaacaaatagaaaattctaaaaataagcattctaatcggaaagctatgcgaaatctactccttatctcgctacttttatcaactggtctacgcatctctgaattatgtaatttaaaacttgataatatcaatttggaaaatagaaccattcaaatactcggaaaaggaaagaaagtgcgactactctatattggaaacgataaaacactttcgttacttgaagactatatagcgcatcattgtagtcattctagttatctatttaccagtgtgaaaacgatgatcatcttaaagaacaaagtgtgcgcttaagtctgaaaaatatttctcactcgctacaactgaaaaaacatatcactccacatatgtttcgacatagttttgcaactatgttgcttgataatggcgtcgatattcgacaaatacaacatttactgggccacagtaacatcaatgtaacacaaatctacactcatgtctctcaaagcaagcaggtagaaattctaagtgagcataatcctcttaaccaaatcacaccactacttcccgcaaaccaagtagacttgacctaaatcactgagtcggatggtcataaaatagtaccttatctaagattgtttctaatgtttcttggttgatagagtgaaagaatgtgacttccacttttccgagacgaattttcatcagaatatcatttctgcctttcttctcaaagcggcgagattggggaacagtcaatgggacgatggggtgtgatactcatttaaaatcaaaaatagccaactaccactcaaagtggatatggaccgtttcgattttgttatttttttagaagaaaacagctgcttgaaatccacaatcctcaactcaaacttataaattaaggtttcaaatgttataagtagcttagaccccaaatttcaagttgaaattagccacccataagaaattcactcggcgacttgtagtccaagcattttttagggtagttgttgatccaatgttcgataaaagcgacttcttttggagtcgttttcttggttcctttaggtaaccatctccgaatcaatcgattgtgattttcattcgttcccctctcccatgaagaatagggatgcgcatagtagatatactcctcaggaaacacttcagccagacgactaaattctgtaccattatctacagttatagacaggatacgatgttccctcaagattccctccagtgcctgattgaccgattcggcggttttgtttggaattaatcgtatgatttggtgcctgcttcgtcggtcggttaagactaagaggcaatgatttttccctctggttagtagaactgtatcaatttcataatgaccgttttccaagcgaagattaataacgtcaggacgttcttcgatagattttcctgctggtttaaagttaggactagcttgcttcttgacccttttcccttttctagggtaaagcatatctgctttcgtcaatcctaaatggccatgatgaaaccaatagtaaatggttgaaatacccactttcattttcttcttcttaaccatcatttcaggagaaaatttttgcttagtatagtgtaaaattttctctttcaattctttcgttaggattatcttttttaccgatcgttttcgattagttcggtataccgtttgtgcatagtcagcagaatagacttttttgtacagcccttttcgcacttgttgtaaagttgtcccacgtttgacttcattatagaactttcataagtagcttagacttgctatctttgatttttattgatactcttcgaaaatcaaaattatccgttgtcaacttgccttgatgaactccaactccagttctatcttcggcttcgtttcctaggctactttgtaaccgcccaataataaggtatattgaaaaggctccaaagtcctgttgactctggaacctttttctatttacatgctctcttaattttcttctcccatggcaaataagcctctagaacttcttttttagcgagtgtttcctcgttaggtagattgtctagaagataggtcatatatttctctgtatcaagttcgtgcctcttggccgtttccaaaagactcaaaatgatagctgtcgacttggctccctcaaaactttgggagaacaaccaattttttctgcccatcaccaaggtcttcatagccctttcagccatgttgttagacaggaccaagtcaccatccgagagaacggttcggaaggtggtttcgtatttgaggctatactccaaagcagtacccaatttggagcctggcaaaacagattgctcacgacaccagtcaaagaactcgtccatcaagggagccagcgtttatgcagtcgctcctcgctagacaagtcagcccagtcaactctccaaggcaaacaggcggtcgcaataggctaagcccttgggctcctaaagaagtcttgtctgtcttcttaggagtcgcctcaaagaactttcgtttgacgggagcccaacaaccaaccagctgagccttgtctaattgacgataagcactccacatgtcacaatgtacgtagcccgcatagtccccaagaacctcctccacaaccaagccactccgtcgtttgtcatgatgatagagggtaattccattttcctcatgtttcccagacaagaaggtcaactgaccatcattttctaagaccttgtaggcggtctcatccgcatggagaataggctgctccaacaatttctcgtgcaacaggttgtaaatcggctcgaaataatactgactagacttgatatgccagttggctatttccttccgactgatgggcaggccaagcttatgccaatcctcttcctgacggtaatttggcaccttcaaattgaacttctgatgaatggtgtgagcgatgatagaggctgaacccaagctgtgtgccaaaggtgccttaggaacgggagccttgataatcttatcgctcagattcttctggctacatgcctgatacttgtatgcgtgttgaacatggtcaatccgctttaattgtgcaggaatgaagaccaactcttgtcgttgaacagctgagccaatctctttcaactgaccatgacagtctggacaagtgcagtcttcgccctgcaattcgtgatgcactatctctggagtgaactgactaaaaatagcctgacgaactcccttagttttcttgcgtttataagtgatgatctctgtttcaactgggtaagtcagcttcttcttcagggaggctttcctccccaaacaagctcagctgaccgggttgatacacaactttctctgatgattttccgtagagtttctgtctcagatagtcaacctgttctcgaaggagggttagctcattggtaagttgttcaatcgttgaggtctgttgtttaataattgccaacaactcatccatacgctcgctcctccttctttttatctcattatacacaaagaaaagccatgatttcaatagaaatcacgactttttgaaacatttatttttggaatgatagaaaatcctttcatgagctaatctacttgttcggaagttagagccttgacttcttcttcattgtttgaccaggccaatttcccattttcaaaacgtttatacaataaccaaaatccctgttcatcccagtaaagagctttgaatcggtcttttcgacctccgcagaagagatagacctgacctgaaaagggatccagattaaattgacttttgacaagataggcgagagagtcaatcccctgacgcatatccgttttcccacagaccaagaagacttgacctaaatcactgagtcggatggtcataatgcagtaccttatccaagattgtttccattacttcagggttgatagattggaagaatgtgacttccgtttttccgagacgaattttcatcagaatatcgtttctgcttttcttttcaaagcggcgagattggggaatagtcaatgggacgacgggctgtgacataatgaatcctccagtttgttttttataacagtatagtcaactgaaacaagagcaggacgaaagtgcctcaagaaaagtatcgcaatttggcaatactcttctgaggtgttttttgatgtgagcccatattttctcaatgggattatattccggtgagtaaggaggaagtggtaaaagtctatgtccctgctcctcgcataaatcttttagcttactcatcctatgaaactttgcattgtccataatgataacagatggtttacctaaagtgggtagtaagaatgttttgaaccaagcttcgaaaaagccactcgtcatagtatctttgtatgtcatcggggctataagcgcaccatttatgagacctgctactaaagatatccgctggtatcttcttccagagaccttaccttttatcaactgacctttcaaagagcgaccatattttcgatgaaaatatgtctcaaaccctgtctcgtcaatataaacaggagtcaagtggcttaagttattcaattctttaaggaacagttctactttttcagggtcttgttcatagtaggtacagctctttttttcgagtatatcccatagctttgagggggtaatgaatagctgttggatgacagtcaaattcagaagctatttcagtcaaataagcatctggatgagtttcaagataattctttaatttatctctatccacttttcttggcttggttcctttaacttggtgatgaagctcgccggttttctcttttaattttagccattgatagatagtgttacgtgaaacttggaaaatagctgatgcttcagtaatactgccggttttctcacagtatgcgagaacttttttacgaaaatctaatgaatatgccataaatacattatatcataaatgtactgtttttgtttcatttaactatataatggaggaatgtgtgattggatagataccttgttattaggcggttacgctttaaacatcaaaaatgagagaacgaatttcgtcctctctaggtgttagcttttcgtctacccactacagttgacaaagagccgtttttttattgtgagaaactagtttttgcccagcctctttttgcttattttcctatttttgggcgcactaagcccacgatggtaatcccagtcgtttgatttgctcaaaacgacagatattgtagagcaggttggttaaggtcacattggtttcagctcgtgccttcccaattgctcgacagatgttacctttcatgttagtttcaatgaagccaaaaccatgctcaacgcgacaacggactttggtaatatgtcgattaatgaccttatcagtctcagtcaacggtttatttctaaaagcacgacgaatcgtgtggtggcgacaaccttctggtactgattttccaacataagcactgtcatcaaaaaccgcttcattggcatcacaaagaggagctaggacattggagtcgtgtacactagctgttgtgacctcataattttcgataagttttgattttctgattgtcctcacgtgaattgcgttgtttagggcattcgacaaaggtagcatccacaatctgacctgaatgggcaatcaccccttcatctgtgagatgggcatagaacaaatcgaacaactccttttcacgacctgacttggttaatttctcacgatagagccagatagttttcgcatcgggaacagtgtcttcatgacaaccaacaaaacgacgaaaagatatacgatccagcagttgatattccatggcatcgtcagataggttatgaagacgttgaagcaagagcgctttgaacatcatgagatagtctaggtgaggacgaccgccacgactgatgactttatctttacgactgaataactctgacaacaatggaagaaagatattccaatccataacggcatccaaacgttctaagggattgcctttctctgatagttttgacaagattttttcatcgtctgtgaataaatgcatgacagctctcctcattactttttattctattatctcatttttgggaaatttagggagtttttagaggtccccttatataattaaacaactaaatggttgtcaattctcaaggctagcatcctctacagatgttattccttggctctaaaacacataccaacatagtctagccactgaaatagcttctatcaccaaattatcttgtcaaacttgtcaaaatcagctgattcacacgctcttgtccaatctgattgaaatgcaatccatcattggtatactgatagtcaagcatcgcctctttttcaacaacttcatttagatcaatcactgaaatacccagttcacttgctgactgaacaataacgtcattcagctgcacaatttcttcatttgaaacgctatcacgaaacagcgtgtaggcaatcgtcgtcacaaaaacctgctctgctttggaaacaagactttccatcagctggcgaatagtatcctcaatcatatgcaagggatagtcagtaatcaaatcattcacaccaagagaaagcaaaactttctttatcggagtagccaaaaagagaccttggttttcaagtgctgtcgaagctgtcatcccaccgatgctgatattatcgaaaccatccagtaacaaggctaacagacgactatcgccaatcacaagactatcatggactcgttgctcacataaacgctttaactctcttttataaaatggtttgttttgttgctcacgacgctggtaatcaaagtaaattcgaccaataacaccagtaaaatcaaagtgatcatctacatcaatcgaatcttccttcgtcatcacataggccgctgttttttcagaaaaataagttttatccgctaaataagcctgcttagaagaaatataaatcgctccattaggatagtagagtgttttctcatcttgacgacgataactgccacctaatcctgcaatatccttagcgaatccgttttcgtctaaagttgaaaacaatgttggagacttatcgactttggtaaagctaacaacgtggtcagcttgacctttcccatataactccatcgcctccttgacatgttttcccgatcttaatggggacgtaacttgcaggagaacaaatacttggtcatcagaaaaatcttgtaaaaaatgttcgttcagttgaaaagaggttgtaaaatctgtcgccaagtcagctggacgcatgaggacttgaaccccagttgtttcacaaatttccttgtaaacctctgaatcagtactgacatatatattttctttcttaaaacatccagactcaatcgcagctcgaatggtatggaaaatcatcggtacaccatctaaaaataacatgtttttatttggtaaaccttttgatcctgaccgagcaggaatcagacaaattggttccatcaattcacctatttaatctttctagcaggtacaccaacataggtccctgactccgtcaacgatttcaaaacaactgtccctgcccccaatgttgtataaggtgcaatctcgatacattgaatcactgttgaaccacttccaatataagtgccttctccgatacggcacaagccatttatggtcactcctggagtaatgttacaatgggcctccaccgtggtatgatgttccacaatggcacccgtattgatgatacaattgtcatagacataggaatcggctcctacaaaacttgaaaaacctatgaaaacccctcgtcccttgatactatctggggaaaaaatattggcttgctcgctaatgatgttgaacaaagcatcataatgatctttggcaagcaagtcaaagatttccttgcgcttgacattgtcacctatagtgacgaagacagcatctacttttccatcatccaaataggttaggacatcttgcaagggaccaaatacaggatagccacgatagtcactgatcggtttatcttcaaaatatccaatgagttcatatcgacttctatccaaccaaggaaggacaccatctgaaaaggtacccgctcctagaaaggctacttttttcatcaaactttctcccctatctatcataaaactctttcatggttgaggcctgtacagataaaaattccttgatagctcgataaccttgtaaagcagaatcaggttgttcaaatggattggtaaaatctatcacatcacgtaattgccccaaaccaccaacaatcgcttccttagaagttccaacatgtaccacactcggtcctgacaaacgtccaaattggcgatttccaatatttaaggtcggaacctgtaatgagggcacttcaatcaaacctgacgaagaattccctattaaaccttgtgaatgcttgaccaaggaatggtaataacgagttggaagcgaagtaaagatgtaagaatcagagtcttgttttacaaattcatgcatcaattccattatcttatcggcatgtgtatccgaattggatccaattatcaaacactggctaccatcttcttttagagcatctaataaggcctgcgtttgttcttcggctgtgttatcctccaaggtaacagggtgaaagagtacaacatagtaatcctcggcaaaatcaattccaagttccatcgccaactcttctcttgtcaaaaagtcttgttttaaaacattttcaacacccatagctccgatgttcagtacatggttgggattttctcctagttgaatgacacgatttctaaattcatccgttgatgtcagatgaaggtgactcatcttggtaatggcatggcgaatcgactcatcaaaatttcccatggttttttcaccaccatgaatatggcaaataggaatattataaagcaacgcagcattggcaactggtagcatctcatagcgatcccccagaatcaacaccaagtcatactggacttcttcaaaaagaaccgtgagttgctctgtcaaggtcgctaaagatttgacgattgtctgcttagacgtatccgtcaaatgcaatggaatccgcttgacaatcctacgcttgtccgcttcgatgtctttgaccgtcatcccatatttttcttctagatgcatggctgtcactacaagatccagctccatttctggatcatcctgtagatagctcaataagcgacgcataatcccatattcggcacgagagcctgtcacaaaacaaatttttttcatccttactccgcttacatttgattttcaaaagcactatggcaaatattttggtcttcctcaaaatcctgctcactcacctgccccaagactttgtaccattccattggcgaaattccatttcctggtcttttgacagtgatgttttcttctgtaaagacttcgcctttagcaattgcttttttggcaacaatagattttctagctacaattttatttcgtacttcaacttcttctggctctttttcaaatttaccaagagattgttccactatcctcactccttttaccaaggctgctaagatatcaggagtagcactcgctttatgatctggtccttccatttcattgtccagagtaaagtgcttttcaatcaattcagctcccattgctgcagcagcgatgggtacttctgaaccaacactatggtctgaatagccaattgttaagtttggaaattcttttttcaaggtatgcaagacattcaaattcaaagcagggtaaggggttggatactcggttgtacaatgcaaaatcgaaatatcggtcgttccattttcctgcaaaatcttcaccgcttgatgaatttcatccataacagccataccagttgaaagaataactttcttagcttgacgaccaattttttccaaatagggaagattggtaatctcaccagatggaatcttataaacgggcatatctgtgctaatcaagaagtccaatgattcctcatcaaaaggtgtcgaaaacacatcaactcccttttcaagacagtaatcacgcaaatcaagatactcttcaaagctcaattccaaacgacgagtcatttcgagctgagaatctgactctcctgttgtaattttttggtattctgcctttggtgcgtattttgaaatcaacaaatctgccttaaatgtctgaaatttaacggcatccacaccacaatcaacggcaacttctaccattttccgtgctagatgaacatcaccgttgtgattacaaccaatttctgcaataatataaaccattttatttcctttctaaaaatgactgtaaatcgctcccataaagtcttgagggagcagcttggttttccttaagtagtaaaagaacactaataaagatcgctacttcacttctgatagccgattagaaaaaatagccctagatttctttcgaatagtctcagggcttgttgcttctaaagcctgcttcttcacacgatcttcaatagattggtggaagtttaatctgcttttctacccaatttttagggagatttacctcatgacttctggcataagcagaggcgcatacgtcctttaagaaacattcccttctttatacttgattatagcacaattttcatggtagagaatacttgaactttgggtagatggcagtgatggtcaattcttatgagcacctctcatttgggacgtttttatatggggacctctaaaaactaattttctaaaatttaaaatgtttgatttaacaaggctttcgtaactccaaattcgcaattttgggagtttatagaggtgcccttatttagaccgtttttccctgaatgtattgagggcaactgttaattcctttctaaaaatgtaggcataaacgactagaaccgctattcctagtgaccaacgaatccagattgaaccgacaaatactgtcatcaagcctgtatagacgacaacaagagcaattaccttaacaaatgttgaaatcgcaacttcatcgtaagcatactttttcttagcaacaaaataatgcaagactagcaacaacagataggaagcagtcgttgccaaagcagcaccataaattcctatcgtcggtatcaaaacaaagttgactgaaatatttagtacacctgctataaaagtaccaattggcaaaaactttgtatttccactataaaactggatattggctggaaaactataaagaaatacaaagaacaccccgacaataatcatgggaataaatcccatactgaaacgatactcagatccacctaacaacatcgctaattcagggtaaattgttagaaatccaaaagtcacaaacaggccaatcgccagatagtaacggacataactgagcaaatctttatctgcacctctctttttctcaaaataccacggacaccataccgtattcaagctcgaaaacacaatttgtaagatagacgcaagtgtgtagccgaaactgtatagggctacatctgacagtgttagcatcttgccgagcatgattctgtcaaattgattgagtacattatgacctaatccatgaaaaataagaggaatcgatatacttaaaccataccgaagatagtcctttcgaaaatgaagcccaatcttcttatagaaaaacaacaaggacacacaagcaaaaacaccagtcgttgccgagtttgccattacacgagcgatgaaatcattctccatcgaaaagatgagaaataaagataaagcagtgttgataacagcgctcagtaccgataggagtaaagtccacatggactgctgccgctgcactaaataggtcgtaaaaaatccttgcacaacactcataaaactttgcaaaaagataagcggaacgacccaatcaggcaaaccaaataggagcgataggggctgactgaggagaaaagatagcccaaaaattggtaaaaagaaagcgatagaagagaccatcaaggtggatacgaaatcatcaaatttctcgcggaagtgtacccatcccgggccaaaagccccacctaactgtagaccgataaagagaccaactagccccacccacgaattatacaagctaaactgcccatatacttcctgagaaatgacacgagtatagatggggagggtaatgaaggctaatccctgaacgaggatggttccaatcgtatagacgagacctgagacaactattgattttttagacatgaatcctcctattctatcccctcacgcaaaatatcattttttgaaagaagaggaaaagtgtcctttaaatacactttctcttcaaaacaatttaaaaaatctaaagcagacgaactataggtcataccgatatcaaaacggatactacctgccatttcgaacaactcaaacggaataccttgaggcagaagcaccacagccttacccagaaatgaataatcaaccccatctcgtgggtgcggttttatgtagattgtatagtcttcccgataaggggcaagacctgctacataaatctccaacaactcctcttcggtcacatgataatcccaagacaagggctgggtcaataatagcaatcgtttttgagaagactcttcatccgctactatcgcccttgctccaaatatctgcagcagcgcttgcaccttctctggcgatgcttgatcaaataattgctttctcggaacttctacaaagggtttataagcctcgtcaaattgtacgagcgacagatcattgacctcaatggattgacaatagagacttgaaccaatcaaatatgttggtttaaaataccattgataaaagagtcttttccagacagatgattgaattgactccaaatcgcacactcttttatccttgaaaaaattataaccatcctccaaaagagaatagggaatccgatgtttatttaaaaaatgaccgacttgacggtgatcttgaaaaatgatcacctcgtcatagctctgtaacaaggaaaggcgttcttttgtttttgatctagctatcaaagaatatagatcaaatgaacgctccgtctcctcgattagatgaacatgctgctgcagttgctccctgacatctggaaaatgcccgatgatatcaacggacatcaaactatctctctcaacgtccatctttaacaaggaaatcaggatctgatacatcgtatggcaaatataaattcgtctcaatttttctccttctacatacagactttaaggataagtaacccctttttataacccctgtacagcttcgataatgtactgattcactctttcttgcccttcatcattgaaatgcaaaacattttctgagtccccctgtaagtacatattcatggcttcttttatctgttcgccagtccgtaacggtgaggtgacttgcagaagaacaaatatacaatcttcataaaatccagattcgtaaaaaagtgcgtactgacttcattcgatggagtatgataagtagatagttctttgggtcttaacaatacattgatgcctcttgtctcgcaaatccccttggggacctctaaaaactaattttctaaaatttaagatgttgatttaacaaggctttcgtaactccaaattcgcaattttgggaatttatagaggtgccccccttatacatttctgaatccgtactgacatagatgtcttctttctcaaaacaacctgattcaattgccacatcaatcgtgtgaaaaatcatgggtttcccgtccaaaaatagcatgtttttattcggtaagcctttcgaaccagatcgtgctgggattaaacaaacagttctcttaaaaattctccttgttcagttaataaatatagctttgaaaataaagggggatactggggtttagaaacagataccactcctctctcgtcaacctatttgaatttctttgtcggaatattaacatgcgaatctgctaataaacgaaatggcatctgctaatctgaaatgagtcattatcgttttccacgtactctcataaacagatccactttgtagaaaatatagccaccaaacaggcaaattagaaaggtaaacaagccgttccacaaattcaacgaagataccttaaattgcactgctaaaaatggtgcgactactgaaaaatacagcatctgggtcaagtagatatgataagaagcaactcccaattttgacaacagtattgctggaatcttctgtccatactttatcataaaaaatagcatagcatacgcaaatgggacgcatagaaaggaagtagacttccaaccataaaaccaggagaagggctctatagaatgattcacaaaaatcagaattgctccaataatcccaaatagggtcgcaatgaaagtatctaccttggaacgccatcctgctttgaaagaaaaaaccaagccctagaacaaaaagataacgaagtgatattagtctatatatatatgccgtgttcagccatgttagcaaatatggcatccactgaaaagtttactaaaaaacaagtaagcaagcccaaccatttatttttctcgaaaagaacatacaaaattggtaataaaaaaactacctgaatcaacaacggaacatagtaactcccaactccctggacccgattctccagaaagtagccacaggacaaatgaacggagcgatgaagaacctgaaaaaggctttactcctatcagatggttctcgaatagctcaataaaacattaacagccatcacgatagcatagagacaaagcatgtttatactttcttttataccactgctgaacttgagctttagcgtctcttgttttgtattccacttattcgttcgaaaataggcagaaagcaacagaaaaattggaacagccatgtcaacgaaatacggaaagataaaccattgacgctgctcaacagaccaatccagatgtgtaaaaataacacaaagtaccatgatacatttaatcgtatcaaagagtgctattctactatttgttggattcattttaatccccttttctttcaaccatttattacaacattcttaccgagtactactttcacttcttctcaatctttcttgaattttatctttccccgttttcagaaagacactaaaattaagatgaagacaccctaccaaataataagcattcattagtaaagcaagtcgcttattttgcttcaattgtttatatacaattctaaatagcgtttggagaagcttcttttgctgtttgctcaaccaatgattatatttgcctaaaaacaaaacagcaaaggctaaaaatgaacgataacactctagtaagagctctttatctcctctactttcatagaagtccattcgttcattttgaaattccagtaggcaatggaagcgatggtcagtcatactagaagttatgatactattttctcggtcaacataatagtacaagcactccttaactattgcaactttttctaactcatagagcaagcgataagtgaagtattcatcttcatgaatcttacccttttcaaatcgaaaatcttcaaatagttcttttttatagagtttattccaggccaccacaaagcgatgaccatccgcctctagcagctttttacaaacattcctgccgctcagaacagcctgatttgtaggaagcggctctgctgttaagaaatgccccgaagcatctaccctatcataaccagcaactgccacaagggcattctctctctcaattgcttcgtgtaaacgttggatgaactccgaatgaataaaatcatctgagtctataaaagctaagtagtcacccttggcgcgacttatgccataattacgggcatctgatagcccgccgttctcttttttaaaataacgaatgcgactatctttcttcgcatatgctaaacaaatttcttccgaattatccgtactaccgtcattcaccagaagaatctctatatgtttgtaggtctgatttacaatgctatttatacacttggatagatattgttcaacattgtaaattgggacgatgatagaaatgttaatcattatttttttcttccctaattaaagtatttaaaaaaattttaaacaaattattagcaacaattaatttacatattcttttaaaaacagaggacgttcgtttaatacttagagtatctaaagaatgcctattgtataaatacttaaatatatgcaatttctttggaagcgattcatctccatttttgaacattaataagctataataaataatatgccactgtagcgtctctttaaaaacagaaaattcatattgtccaccaaatattttaacaaacaaatcaaaagttttttcttctaaattttctaattgaataaaaacatcttttttaaacgtatttgtagtactttgtatacctcttctagcaaaataaagatttctgtttacatagctgactttttttatattctttaaataatttagattaaataataagtcctctcctaaccactgttcagtgtcaaaacctttgtttatatatatattcttataaagtttgcaacaagggctattaaagataccgctcatataatgatttggaaaattttcatttcctaagtctcgcacctcttttatctcttccaaatcaatttgacacttttgcagctcagattcttgataatttccatcaaaagtagcaagtaaccctcccgacaaatcactatcattctcttttaaacaggtgtataaggactcaacaatgttgccgtcaacaatatcatcagaatctacaaacataatataatttgctgtgctatttttgataccgtaattccttgcgtttgaaacaccaccatttggtaaccggaaaagttttattctaccatcttgctctgcgtattccaaacatatatccgttgatgaatctgaagaaccgtcatctatcaaaagaatctctagattagtatacgattgggaaataatgctatctaaacactctcttaagtacttttccgtattaaaaataggtacaataatgctgactttttccatcctctaattccttttatgccgtaacttgctttgctatcataaaaatcatcatgtaaaaaatactatcttctatcttgccacctatagaacatatgctctaccaaattaatagcaactcaaaactctattcctgccaatttatgtttgcagttgtttgttaatagttgattccatagtagatatagaatttaataaacaaaaacatattggcataaatacaaaacttaaatttacaatataattttctactgttgcagataggactacaatgataaatacagactttcctattgtttttatattatctgtttttaatattcttacattacgataaagtttatataaaacaatcccataccctaccagaccgataaaaccattttttaacataatactcagtaagggcatttcaagcgttccattccaacctaaaacgcgtctaacccttatagcatagtctaaagttaaatccccatatgccaaatccgctgcaccaaacattagatggaaccaatcatttctataatactcaaaaaaattaataagaccattaacgcgatgagcgtaagaatcactatgtgttattaaaaaaccaaagaaatagtataaaaaaatagcacaaaatagcatggaaatatatttaagcgtactccattgtctttgttctattttgattttgtcaagattaacaagaaatagaaaaagcaatagtattaaataaactgagcgtgtgtttgaaataagaatcaaaaacaattctaatcctaaaataaaacgatccgttcttttataggaaccatacttatacgccaagtaagttaatacgaaccccattaaaatagttattccaaaaaagttcttatgcgtcaatcctccattaaaaccctgactaaaaccgataccttctactgcccccgtgaacatcgttgcccccatcattattcctaatatcgaagttataaaaagagcgaataacaaatgatttgaaatccgtctaaaatcatcaatatcttttatcaaacttattggcaacgttgctaaaactgaaataatcatcattgaaattgataaatatattttagttgttataggaagaatttgctgacatattccgatagtaaataaaaatataataagaaacaaataccctaatttataaactacaatatgtttgttattttttaataaatcattaactatacataaaatcaaaactaaataagatagatactgaatcacagaagctttgcctatcgctagaacaacttgcgaattactaataattatgcccataaacgctatggcaacaaaaaacaaattattaattcttattctcatttttccaaacgtttttctcctatctgcctgcattacttttaaaattacaaataaaagtaaacaactctcacaatctcgacttgatttttataatagtgtttgcaataccgtttctctgaatatatagataaattctattgagcatattcggaacaaatcctaaaagcgcatacaaattaccaataaagcctatctcttttcgatactcttttaaagaaataatctttgacaagtctacacctgtaccaacatactggcttttaacttgctctatatccaaggtatctggtacaacaataaattcatgcggtaaaaacttagcaaaatctggagttataattaatctataattaactttgagaaatttaatttggtgattatcggtaagtaagcctctgacgttatacatttcagttaagatcgtcaaatgatttgatggattgggatgaatatactcatctccttttaacccatctaatacaaatataataggttttagaaatttcttttctttttgttttcgctccacattatatgcacgaacagccatttctcttcccgttttcatcacgcgttctgctactgtttctctggatagttcgttatattttattacaatattttctttacaaaaacttaaatcaattggtgcatgtataacattacaatcataacctgaataagaggcttctctcgccgtttcccacatatccacgccagattcaatgagcgccatctgatttgttctttgagctgtttcgatattgttctccatagtagcaatatcgcgaatagtgtaacaaattgttttataaattaattgctcttggctaatagctcgataatgtgcaaatttcaaatcattatgatgttctatccttacatttgggttaccaaaaacagtgtgatgtcccatcgatagctttaaattcatttttttgtaatacttagcggaaattatacatttagtaactggtttaccatcagaatgatgccaaacaggtttttcaaaacaatattgcattctacgtggtataaacgattcattaatatcatcttttttagtcataacaaaccattgccaattcacataatgtatcttttctaagtccagttgttccaaaagtttccgtggatttgaatcggctgttaaaaattcatccgcatccaaaggtattatcaaatctggatttttttcagcaattattttcgttagatatttattatcaagtcgatactgattatatgcctctaaagactcatcatatacggatattttatatccctctttaatcaaattaaaaataatttgcatcgtgttatctgtacaaccattatcaataatgaccatctcgtcaataaagttataattataccgtataaatgactctattatctcactttcgttattaaccattgtaaaagaaataattttcataaattcctcattctcttttttgccacgaccatcagttctgattttacaccatatatttttcgaaatatagtgcatagattattaagctccccccaaaaaactgaactcctaaaaatctaaatattgatttaacagtttttctacaatccaattaaaaatgaagtttttgaaggctcccttctgttatcttctattttaggggagctctaaaaactaattttctaaaatttaaaatgttgatttaacaaggctttcgtaactccaaattcgcaattttgggagtttatagaggtgccctttagaaataacttataactgtttctgaacatttgttttatcgaatgataatacgataaatcgctatactaaagcattcacttcagccaatcagtatactttgagggaggtgtagactttcgaaaaattttttacatagctttttaacgaaaaatgttctttttgacgttctatagaattattaccaattttttttctgagatttatattttccgataactgaagaattacttttgataaatttaacggtgagttcggagtgactaagaaaccgttaacaccttctttcaccatctcacaaacaccaccatgtcggtaaccgacaacaggtttaccgcatgccattgcttctagtacaaccgttggtagagggtctggattagtacttggaagtacaaaaatatcaaacatattatataattcagtggtatttgcataataatcaattcgtctgacttgagaagagacctttaattgagaaatcttcttttctaattctactactcgccactcttctccttcaaaagcacttcctgctataaaggcgatagcttttggattctgttcgagtataggagcaactgcttctaaaaaatctccttgtcctttccacgcattgactcgaccgaccataccaatgacaagagcctcttcgtcaatgtcaaatctttctcgaacagaccgagcatcggactgataatacactttattatctaccccattgtagattacactgatttggtcatctttgatatgaggtgattgttttatatggtttgccacagcctgtgaaactgtcacaatcttatcagcaaaacgccccattaaaaaattgatcgaatcagagatgaatttaggtttgacaataatctcatgaacatgccacaacaaaggtaatttgagttttcgcttcagataaatgccttctaagacagcggtagtattattgtgaattatgtcaaccttattttctatggcatattgagcaatctgtttagaatagtgatgatatgatatgaagtagtcaaaaatcccttttggattaaaatatttcctacgtagaattggatagttaataacttcaacttgcgcaccaacttctcttaatgctggcactaggactccatcattaggtaggataacatgcgcttcaaattcattcttatctaagccttttataagttccaagagaaccttatctgccccatataattctgctccagcatggagatatagaatctttttcataacttatcctttaaacaacttctcatactcatcaacaataaaatcccaagaaaatctttctttgacttgttttgttgataaactatccatatcattaatttgttcttgtgataattgctcacaactgtcaataactctgtgaagattatctttattccagtatttcgctccttcttcccctacttctctattaaagcccacatctagaagaagatttagtttagtagaagaaagtgcttcaagtaaagatgggttcgttcctccaacctcgtgaccatgaaaataagcaaatgcattttcacgaatatattttaacagctcctgattatagactgttccaacaaactttatacgcttatctttatcgaaccctgtttcttttttcaatttctcataaaaggaattatgctctacattcgttatcaaaacaaaatcttttcttgaatatgatttcataaactctcgaatcattacttcatagttattttcaggcacaaatcgtccaacaaccaaatagtaatcattttctgaaatttccttctccttataccactcacgtactacactatctgtcggagaaaggcgtgatttatctaagtctgttccataagcaatataagatgtttcaggagcatattttcgataatcttcatgaatatatttttcaatatttttgctatcacaaattagtaaatcagcgtattttaacatcaaactctcagaaaatttccaatactgtcggacgggataactccacttttcacgtagccattcatgaccgtctgggtttacgaaaagttgacctccaattgattcaatctgcttcttaaaaagataaatgaaaggaccaatccgacaagcaagaatgtagaaaattggagaggtatcatttctatctttggcaatttcaatagatttcttgagagccataatatcataaagaatggcttttgctgaaccaatatttggcacatcaatattaaaacatgttgctccattatgttcaaaaacttctcctgtaatatctgattttgctgaattttctcttgtacatgcaacaaaataattaattgatttatctttctgatactcagttaatttttctacgaaagtctcgaaaccaccatactttgctggtattccttttgaaccaataatataaactgttctcatatcccctactactattctttgttttaaaggagtcttacttacttccctctctcaacaatacaactttcactgtcttcaataaaatcttaatgtctgaccagatggtccaattatcaatgtatgttaggtccagcctaacgacttcattaaaatctgtgatatcacttcttccgctcacttgccaaagacctgtaatccctggtttaaaactcaatcttctcttttgactaggagtatatttttcaaattcatcaactgtaggcggacgggtaccgactagactcatatctccaattagaacattataaaattgtggtaactcatctaaacttgtttttcgtatgaagtgtccaattggagtaattctaggatcgttgtccattttgaacatcccaccttgcatctggttttgagccattaattctttcttacgtacctcggcatcaacaaacatcgaacgaaacttgtagaatgtaaatatgcgtccattctgtccaactcgtttctgagcaaaaatggctggtccaccatctctacgaataattggaattaacaaaatagaaactataccacaaataattaacccgactactgctccaagtatatctaaaagtcgtttcatcaagatgtgactaggcttataaaaatttgtggaaaaagtgacgatgctatggtcacctagcatttggatttttttattcttcaacacagtaaaaccgaatgaattaatatcaacgcctacatcaatacctaacaactcaaagtctgaaactaattgctttaagtcaaaatattcacttggtaaatttataaagacgtagtcgaccacttcccttgttgaaaactctatagcttcttcaacagaataatagagcggtaatggtaaattaattttatctatttctgtacctaaaattaccaatgcaacaagatttttttgaaatagtatatctgattcaaataaaacttgcatattttcccatagttcagccgttgtaattagaatcgtctttttttgataggttgtcgaaaatagaaagctatccttaaactgcttaataattacgttaaataggtataccaaaacgaagtttattaatgtgaaatacacggcaccacgtcttgaaagtgcgaaattattctctaacataaatgaaactgccataagaaaaattacaaatattatactatagttaaatgttttttcaaactctatcagattacctctatactcaaattcaaccggcatacgagatataaaaaatgcaaaataatgaaccatcattatgataaaaattccagaacgatttaaatcagcatttggtatatgacttgttaagattgcagaaatcgcaactgctatcatatcaaacaatgccaatttcgtttggcgatatcctatttcaatattcatagctcctccactatttctatgaggttactgtacttgatttttcaatatcaacaaaggatttttcttgaacaaagccttcgctctatcctcaccatactctttttttacaagctgatacgcctccctcataaacggaggcctactatataaattatgcatatcgctagcaacacaatgtactaaatcctgctctaaaaaatatcgagtacgttttttaaattcttttgctcgttcgccaattaaagcaggcttcaacacatggttactatttacctgagtgtagcatcccttgtcaattagcttttctactctctctgactgaaatgccagagcatcataacgctctatatgggcaagtacgggagttagcccaagtagcgtcatttcgttcactgcttcttgaatctctttccaaggagtatccgtactgaactccaagagaatatagcacgagccattaagtgtgggtactttctttttttcaagtttgcttaagatatctttactataatacaattcagcaccatagcacaatcgtatttcaggataaacttctgctactgcctctttaagttgaagaaagttaatcatgatgattttttctggtgtttcaaacatcccttttcgtctatgagatgtcgctacgatatagcgaacaccttgacgataagcttcgcttatcaaactcaggctctcttcaatagttttgggaccgtcatccacaccaaatatgatatgcgaatggatatcaatcatattaatacctacttatcaaacttatgttatctgagaaattaggcttttttgccgtaatttccgtattcactatacttctcagtggcaatatcatatttgttcaagataacgcctaagaacggtgtgcctgtttgttccaactgctcttttacttttttcaaagatgagcacttaacattgcctgcttctactactgcaaccatcgcatcacatttttgtgcaatgatagctgcatcaattaccagtcctaatggtggacagtcaacgataacataatcataatagcgacgaagagtcgcaagtagattttcaaaattcttactttgtaaaagggcagtagggttgggagaaacctttcctgactcaattacggtcaagtttggaatatctgtatcgcataatccttgagacaagtctgttgtccctgctaggtaatccgtcaaacctgtaatctttgtaattggcttgaagaaaccaggcatgactgaatttcggatatctgcatccaccaagacggtcttataacctgaacgagcataggcaatagcgagactagccgcagttgtactcttaccttcattcgatttaacagaggtaataccaacaaccttaatatctgctccgctaagctgaatattggtacggatagcattgaaatactcctcggttttatttactccctctctttttgtacgtgcaatttctaacatcgccatattgttctcctattttaatttcttcgaatctggtactatacctagcaatgtcaatcccattacctcttcgatgtcctgaggacgttttacacggtcatccaaaacctccataaccagtacaagacctgttgccaagatacctccagctaataaaccaagcaagatatttcgttttgtatttggagtggttggttcttccgctgggactgcttcttcaagtgtcgtcacatcgcttaccttggtgacctcaacaaccttttgcactgcaaaggtgcgaaggctatttgcaatacgtgccgcttcatttggatccgcatcacgcacagaaatagaaacgatacgagtatcaacaggaatagaaactgatattttttctttcaaactctctttcagattcaattccgttgctacttgtgtcaatacatcttgtgataggataatttcccgatagtcttttgccaaataggtacccgcttgtaactcttggttagtcaagcccgcaccggcttcaacattttgactcactacatagatacgggtagtggagtcatattgaggtgtcactaaaaaactactgtagacaaatgccaaccccgcagtcaacactgcagttaagagaattaaaaatttctttctccaaattgtttttagtaagaataaaacatcgatttcgattgcatttacttcttgattgttcatattttctcctaaaatctttatttttcaacaagtacggactgaatcgctgcctttgattgctccagactatcttggttaatttccatcatataaagttgtgatccaggcatcgcataagaagataagtctgagcgtcctgttcctgtcaatgcttgtgactctactgtaaattgtgttcctgattctagttgggtattcactaaactcataatcgtttctaagctcaaatccgtttgaattgagccttccaatccagataggattgcctggtaattttttagattctctggcgtactcatctttttaatcaaggcagcaatcactttttcctggtttttaccacggtcattgtcaccccctgttaaagagtagcgctctcgaacgaagcctaatgcttggtctgagtttaaatgaacttgtccaacagggaaatgataattcccatgtaaacttgtaaattcttgatcgttatatacatcaattccacccaccaagtcgattaattgaaggaaggaaatgaagttcaaccgcacataattgctaatgtcaatcccatagagattttctaaggtgtgcacagaagcattgacaccgtagataccagcatgtgttagtttatcgtattgattttgcccgccatctgcgatagcaacgtatgaatctcgtggagtagttgtcaataaaatcttatgtgtcgcacgattgacagtcataatgatattgacatctgaacgagagaccgtagaaatcggtccataagcatcaataccactaatatagatattaaagctatctccactcacctgcttagtagctgtttcaacagtctgagtcactttgaaactatatatttttttcacttttgaagaaaagcctggatcttcattttctaaaatattggtaaaaactccgttgaacaccatcgcttgactctcgccattcaacatagattgatatgctgtcaggtaagaggtcgcggggctagttgctagttgagtagattccattttggatatgtcatccaataaagcggtgatgttatcttggtcgtattcggctggagcaaggatactagtaagctgacgaacgtccgtaatatcactatttgctgggacaaggatactcatttcatattctgaaaatgtcgaatttgaatttagtcgtgttgaaaattttacaacttcttgcattccatagatcccaacagacgtgatgaccagtgaaaaaacaagtaagagcgctgtaaatatgcgcgctttcttacgccacatcaataatccagccaatactgccactcctactagcaaaagcgtcacaatatagtttaaataccggaaatctaggatgttatagcgatacatggtcactaagaacaaacatagagtaatggaataaagtcccaaaagcgcaaaatttaccaatttgaacttggacgacttacttcgtccgcttctctttttcataaacaaccttcctagacttttacctataacgcatccattatatcatagaaattaatatttttctaccctttttagcgctggaaaacgttatctttttcataatttcacatttttattgatcgtatgaaggtaagttggtttgccgttgattcggaagtacaatattcaaagccatccaccttaaaatcttgaatgtccgataattcctgaatattgttcttagccaaccaggacagcaatcttcctctgcctttttttgatatagtcgagtgaacttttagctgacctgctttttcttccatgaaaagaattttaactaatcttttctgaatctgtggagaaaacacctgctcaaattctgacgaagccagtgagagaatcagttcatcatcaccaacttcttggtcataatacggtcgccagtactgtttcaaagactgattgcctatctttaagctcccttgaaaatctaagcggtgaggtgaaatgaattcaaaaggatgaatcaatccgtataaggctgtcgctacacgaacgtggtcacgtagataattttcttctttcgaatctatacctcgcctatccatataacgatacatgagaccatcatataactgccaggctggataggtttttgcttgacctgtcctgattcgataccaacggtcagcttctaactcagcctttgcttcattcaatttataaaaggcagccatcttttttacatcaaattgacttatggcatccagcaccggcttgcttcgatcagacaggagataaaacgaggcattctctagatttgtatttacttcttttgcattaggtataattattttcatcacttaattataccatagagtagcttaattcctgaacctcaaccccattattcatatattgtctttcttcaattttttctatatactagctagtaacatagtctataaaaaaggggacctagatgaaaaaatatcaagttatcatccaagatattttgactggaatagaggaacatcgattcaaacgtggagagaaattaccttctatccgtcaactccgcgagcaatatcattgtagcaaagacactgtccaaaaggctatgttggaattaaaataccaaaataagatctacgctgtcgaaaaaagcggttattatatcttagaggatagagatttccaagaccatactgtagagctcaatcctacagactttcaagaattaccctatgaagattttcggatttgtctaaaagaaagtcttattgggcgggaaaattacctattcaactactatcaccagcaagagggattggcagaattgatttcctccgttcaaagtctgttaatggactatcatgtctatacaaaaaaagaccagctggttatcacagctggtagtcaacaagctctatatattctcacacaaatggaaaccttggctggaaaaacggaaatcttgatagagaaccctacctattcacgaatgatagagctcattcgacatcaaggaatcccctatcaaacaattgaacggaatttagatggaattgacctagaagaattggaaagtatcttccaaactggaaaaattaagtttttctacacaattcctcgcttgcacaaccctctcggttcaacctatgatatagcaacaaaaacagccatcgtaaaattagcaaagcaatacgatgtctacatcattgaggatgactatttagcagatttcgactctagtcatagcctacctttacactatcttgatacagataatcgcgtcatctatataaaatcttttacaccgacactctttcctgccctccgaatcggtgcaatcagccttcctaatcagctacgtgatatcttcatcaaacataagagtctaatcgactacgataccaatcttatcatgcaaaaagctctctcgctctacattgataacggtatgtttgcgcggaacacacagcatcttcatcacatttatcacgctcaatggaataaaataaaagactgtctagagaaatacgctttaaacatcccgtatcgaatttccaaagggagcgtgacctttcagctaagcaaggggattctttctcctagcatccaacacatgtttggaaaatgttattatttcagcggacagaaagctgatttcttacagatcttctttgaacaagattttgcagataaactggagcaattcgtaagatatttgaatgaatgaaatccaatagtctcatacaaacaatccccctcgaacttagaagacgagggggattattctatagcggaaattacagcccaaaattattactctgtgaatcacgctttcacttcgtagcccatcaaaagtccaccttcttcagcataaaaactgcatagacctgatgttgcaacttcgtcaataacagccgttggaaaacttgcttttaccaactctgagaattgttggaagaacttagcattgttgcggtgggccataacaattcgaccaccatcatagcctgcttttttcatttcttcaaaggctgctgtcacagatttcttatgaccacgcgccttttgaagcaactctaattttccttcagcacttgcctcaccaaccatacggatattgagaagaccaacgacagtgcctaccaatttgctcagtcttccattcttaacaagattatcaactttcgctaaaacaaagaggagcttactgtgttcccgatagtgagttatcgcttctactacttgtggaaaatctaatcctgcactaattaagcgattgatttcgtctacaagtaaatccatttccccactggctgacaaactatctatcaaatggatattgacattcggatgctcttcgatatacatatccctagctacacgtgccgcattaaaactacccgatagcccacctgtaatcgtcacaacgataatgttctcagctccctcaaaagctgcctgataagcctgcggacttgggcacgccgaccccgctgcagacttagatgcttccatcacctccatcatgtgatcaatatccaagcttgcatcatcaacaaatgcttgttctccaacttggatggtaagtggcacactaataaattcagtgtccggagctagattagctaattgacgatagtcgcagcccgaatctgcaacgattttccattttgtcataatattctcatttccaattttatttttttatttgacaataaatctctatttacttacaattatatcattaaactaccccatctgaaagcattttctttcagatgtgacactcggaaaaggaaaactatggcaggtcgtaaaatttcaccccaatctttgaaaaacctctatcaatcaaataaagaagcgaatcaactgactaaggaatcaatagaaactgctctgctatttctcctagagaaaaaggagctcaagcaaatttcggtatctgaattggtccgaaaagctggtgtgtcacgcaatgccttctaccgcaattacaagtccaaggaagaaatccttgaagactactacgaacggacttccagcaaccttaaaaagaaatggcatgatttgcaggacaaggttcaaaaggacggcgtcaagcaaagctttgcagattttgtccaggaacaaaaacgcaaggcagagcaaagcaaggccctgtccaacgtcagtcaatggatcaaggaaaaaacaaaacgggattaaaagtcccgttttttgctgtcttctattttttgcctaattttctagtctttttgagggcggcggcgactgccttgataatggcgtaacggaagccttctttttcaagagctaccacacctgcgatagtcgagccgcctggcgaggtcacttcctgtctcagctgggctgggtgtttatcgctggttaagaccatctgagcagttcctgccagggtctgagccgccaataccttggcatcctgggccgtcagcccgttttgcacccctgcatctgtcagagcctcaatcatctgatagacaaaggctggtccgcagcctgcgatagccgttgctgcgtcgattaggctctctggcacttgctggaccttgcctgatttttctaggatttgttccaatagcggagcgagattttgattgaccaggctataggttgtcatgccttggccgatagcgactggtgtattgggcatgatacggataactttatctgccgatacaaatgctgccaggctgtcaaggggcactcctgctgccatggaaatccagatagctgacggattctggctaatctggtcctgcaagcctgacaagactgtctgaatcaggtgaggcttgaccccaaggaaaataatctcggcctgctctgctatttgtccattagaaaaaagctgaccgcctaccttctcttgaagagcctgggcttttgctgggttatggttgctgaggaggagctgggtatctggctgctggctgaccgcttgggctagggccgctcccatattgcccagtccaataaatccaatcttcatcttgtcctcctaacgaatgtggccgtcgcctgtgatgatgtacttgtaagtggtcatttcacgcagtcccattggaccacgggcgtgcatcttctgggtggaaatacccagctcacagcccagaccgaactctccaccgtctgtaaagcgggtcgaggcattgacatagactgctgccgagtccacatggagtgtaaaatgctctgctgtctggctgttttccgtcacaatcgcctcgctatgtccagtcgaatgttgggcgatatggctgatagcctcttctacacttgaaacgaccttgaccgccatgatatagtccaaaaattctgtgtcaaaatcttggtcgcctgctggtctggcttggttgaggagagcctgggcctgactgtcggcacgtaattccacctgaccagaaagagcttcttccaagcgaggtaggaattggctggcaatttcttcatggaccaacaagacttccgccgcattgcagactgagggacgactggttttggcattgaccacaatccgcaaggccttgtccaagtccgcatccttgtccacatagacatggcagatacctgttcctgtttcaataactggcacagtcgcattttctactacggcttgaatgagtcctgctccaccacgtggcaccaataaatcaatcttgccttttgcggtcatcaactccgtcgcagagacccggctggtatcttggactaactcgatgacctttggtgagacaccagcttcttccaagccactcttgagtgctgtgacaatcgctttggccgaatgaaaagcttccttgccaccacgcaagatgaccgcattaccactcttgatggccaaggcagcggcatctgaagtcacgtttggtcggctttcgtaaatcattcccaccaaaccaaagggaatggatttcttgcaaatgttcaagccgtctgcccgagtggattcttccaagactaatcccacaggatctggcaagccaatcaaggcacgaatgccatctgccatagcttcaatccgttcctctgtcagcagcaaacggtcctgcatcacctggctaatcttgccttgggcatgttccatgtcgatggcattgcctgctaaaattgcctcagtctgagcaaccaactggtctgccattgctgatagagcctggtttttctgttctgttgtcgctagattgatagaagccttgttggccaataaactatctaataatacttgtgttgttgtcataaatttctcctatttagtctttcagtttactcgttcgtcaacataatcgagacaaactgaacaactataagctcacccaatcgttgcggtgaatcaacacgccctctgctctgccatttgccaactggtcctgcaagtccttggaggacagtttgacccgacctttaccaatcaaacgatggtctgcttggctgtaaacttctacgacctggcccacttcaaagtctccttcgagggctttgacaccagtagctaacaaactgcggccctggtgcaacatagcatcaaccgctcctgcatccacttcaaccgccgcgtctgtccgagcatagaaggccatccactgcttgcgttggttcatggcatggtcatctgctaaaaagagcgttccacgattggcttgggtgaccgcctgcaagagggcggtatcctcttttgaagagcagataaagacgggcacgcctgacttggtcgcaatctgggccgcctgcaatttggtggtcatgccacctgttccattggacgagcctgctcctgctgccatggcaaataaatcttccgtaatctccttaatttgaggcaagtgctgggcagtcggatcgctgttaggattggcagtgtaaagtccatccacatccgtcaagagcaccaataggtctgctttcaagagagaagccacctgagcagataaagtatcgttatcccccaccttaatctcctcaatggcaatggtatcattttcatttataataggaatagcccgttgcttgagcaagacctgcaaggcttgagaggcattctgataacgtctggcatccgcaaaatcatcctgggtcagtaaaatctgagccgatacgatgccgtccttcattagattttgcgtatattcctcaatcagcaaaccttgtccaacggccgcagaagcctgcttctccgcaatcttggtcggtcgcttgtcaaatcccaatctccgaaaaccagcagcaatcgagcccgacgtcaccagcacaatctggtaacctttctggtgcaactgagccagctgattggtaatccgagcgatcttgatacggtccagactgccattttcttgcgtcagagaacttgtcccgaccttaaatacaattgttttttctgtcataatctcttctcacaaaaactaatatttggaaaattataccatattttaatcataaagaaaatcactgttattcggcaaggagagagggaatagattcctaatcatgagtgcattaaaaaacgctggaaacaaaaggaagccttgtggctccctttcaacttattcaaaaaaatcttgaatagctccttctatttctttcgcatccacacttaacattaaataatctttctcaaagaaggacagaatttgctgtccatagcgtttggtgtgaacacgcgggtccaaaaccaagactagtgaatcttgtttgtcatggcgattggtacgaccgatggcttgtttgagcttaatcatcatcataggcaggctgtaatcataaaatggatttttcccttcttcacgcagatggtgattgattttttgtacaaaccggtcctttggattgtcaaatgggagccttgtaataacctgaatcaattgattctgactggcaaagtcaacgccctcccagaatacacctgtgccgagtaaaatttggcattcccctcgttcaaatttgcgtttgagagtcatttcctgtccatgcttgtgctgggctaggtggggaatgttattgtcttctaacaaatccgacacctgcaagagcatagaaatcgatgtaaacaagaccaaaatcggtcgtcccagctctgctatctctcctaaagtagtagccaaatatgctgcatgctcctccttggtccaagcgaggatgtcggggagatgggtcggaaaaagtagccgctggttggtcacagtttgagtcggtatcaaatccaaggtgacctgctcaaagcccagcagatccgccagactgacctttttgctgatggtcaaggtggcgctgatgcagaaaatcttagtatctggcagatagttggtcgcatttaggaggctatccttggagctccgcaaataggcaagccgcttttcttctaaatttttctcctccaaccaaaaggtatcgtaatagtctatgagctgatgcaagtcgttcaaatcaacatctccaagctcctccaggttctgaccaagttggtgaagttcagccttttgaacctctcgttgaccatgctgacgaaaacgactcaaaaagtggttgagttcaaactggcaagactcatacaaacgttggtccaaaatagccgtcgctctatcctttttactttgcaatacttgtaacatacttgtcaaatcttgcgaagccgtcgctagattttcagcagccaagagaaacttttgtgcttcatcaatcaccaccatacgcttatccatgtgaggatcttggtccttaagatggctgagaaaataagcgtggttggtaatgagcagtctactagagagagcttgttggttcaatcgttgccaaaaatccaagccccaaaaaagactttcaggctccaatttcccatcgtgggcaatctcatcaaagtaagcttgatagcgttgtttttgcttaagctcatccaaatcacctgtcgtggtttcgcataaccagacaagcacctgcattttgaattgattgaccaggcgattatcatcctgcctctgcagggttttccagtagttgtctaacttgataaaatgcttgggtgattttagagagactatgggaatacgaaatatctctttaagcttgctcccttccttttccataatctgctcttgaaggagcttggtcggtacggtgaccaataaaggctggtctgacttagcaagtaaaggcaagagataaccgtaagtcttccccaaacctgcctgcgcttgaataaaatgcactttttcttcgtcaaccaagcgtttttctactacttgagcaaaagcagtttgtttttttcgttcatgcaagccgagaagggcaatattggtcgaaaaatcttcagataatcggtaggctgacttgatttcttctggctttttcaagaccaagtcatgaatagattctaaatcgtatgatagattttctgacagaacaggcaccatctcatcaatgaccaaacgggattcaaagagcagattgtccgccaaatcaagaatcttttcaacaatagacctgggtaagctctttattttctcttgaattttgatgagcaagcgcgccgtagccatggcatctgatatggccgtgtgtgcctggtccaaaccaagttccaaatgctctgcaaggtttcccaagctatatttttcaaaagtcgggaaaaatagctgtgataattctaccgtatctacacgcggtgtcaacagttcataaccttcaaaaaagagtgcttctgccaagagattagcatcaaatttgacattatgggctacaaaaatagcatctccaatcatgtcgtaaatggtacttgctacctgaccaaaatctggagcctgacttagctgttggtctgtgatacctgtcagattcttgatatggtcatccagtagctcatagggattgatatccgttgcataactgtcaatgatttctccattttcaacgagaacaatcccgatttgaatgatttttgcatcggtacctgtaccagttgcttccaaatctacaacggcataccgattgcttgttcttgtgtctttcatactgttcattatagcatattccctctcatggaaaaagctccaaacaaattccatgaagaaggcgtgtttttttgttagactagtaacatcagtaactgttagaagaaggaaaaagaatgattattcacaaatctgtcaatcctgtcgcttttcaaaatacctactaccttgaaaatgatacccatctgattatcattgaccctgggagtgactggacaaaaattcaagtaactatcgaaaaaatcggaaaaccaatttcggctattctcctgactcacactcactatgaccatattatgagtttggacatcctgcgtgagacctacaatttcccgcctgtctatgtggctgaaaatgaagccagctggctctacacaccagagatgaatctatcaggtctacctcgtcatgatgatatggaaaatgtagtctgccgacctgctgaaaaaatcttccaataccaagaagactaccagtttgacggttttcatttcaaggtagttccaacacctggtcactctattggtggtgtttcctttatcttcccagaggatgaatgtgtcatcactggagacgcacttttccgtgaaactgtgggacgcacagacctgccaaccagcaactttgatgacctgattactggcatcagagaacatatctttaccctgccaaatcactatactgtccatccaggtcatggtcaaaataccagcgttggacatgagaaaaatttcaatccattttttagaatgtaaaataagtactgcccagttctgattgaactaggcagtttttttacccgtgctactagttaaagtcaaaatagcttagattgtagataagtaggatttgttcaatccgtagctgtaatccgagcagtcctctggcaaaggtttgttctatatcaaacaaagcgtatgattcagaaaacgagtttcaatggttcgcctcatggctaataatctccatttgttatactaattaactccttccatgttctatccttctgttccaagttgtctttaaactcctgactaaatctgctaaaatcacagattactgatagccttccaacaagcaattcactacataatcagaaactggtgtaataacatagttcaaaatatagccagatagagtaactttaaaaaccatggaaccacaagtttttcaatacatgcaaccaatatctacccccttcaaaaactcttactttatagttccgaataggatagaaaagctatccttgatgacaatagtatcaggtgaacattgcttactcattgcttgattctcaacgagtagtaattggggggttttctggttaatagcaacagagatttggtcgtttttttaataagtgaatttcagcgacaaccattttcccgcatcctttacacttgaaccgacgctttctaagatggataaggagagaggattatcagctgcttctaagcaaaggattttagatgctctttggaagttgtatttcactatttgtccctttcaggcaagacattttggagacacacaatctaagtgagtttccacatcatattcagtcatgatagcgatatttttgtcttctattccaagaaaatttgtgataagatcttcgcttttctatttctaggctcaggaatcaagagtcactcccctaactcttgatttattccatatgacctctttctaatgtaagttttttcgcttttcattataggtcatatgacttttacatttaaaaggctccatagtggttttacccgctacagaaattataggaccattttttgcccatcctcggttcatttgtcacatactttacggattgtgatggactaaaagtcatataataaaaaatcctagggagtgggaaaaacgaagtaccaagattcgacacgggaattcctattggaagaaatgcttatgtcaagcggccttcgctgtcaaaagacaaaaaggcagcccattagcagaacgatattatcagattcaaagtcggcgtggctcacaaaaagcaaccattgcacttgcgcatcaactattaaaaatagcctatatccttttaaaagaacagatgacttatcctgaatttttagcacaaaaaaagactactagggacgaactagtagcctaaatacaaatttttttcactttgattatatcataggaagggaatttttgcattcttttgagttttcgtataagaactcgaccagacgaaaaaaagttcgtcaacaatttttcgttttaagttgttgagctgaaacaatctatccccagacatcaatttatgtgagctgactgccgtcagcttatatctcccactttaaaaggtctcccagaccttttaaactcccacccccgcatagctccaacagtcagaatagtgactgtttaagccaatcaaccactgcgctgagatgttgacacgaactccgagatgtggcgctgagctttttgctcagcctcgtagaatcttaagttaatgatattggtgtacaccccaccgttttcacgagttcttttcattattctgtggatgagggtgtaaccatcatggatgtcttgttcagtcacttttgcttacattattatttttttactgtgtcggttgcaacatcctcaccaaaccatttttgggagatttcttggaatttaccttctttatataattcagcaaacgccttattaatgttttccacgagtgtcgtatctgatttacgagcaccgactgcgaaggcttcattttcaaaacctgcatcaatgatgttgtaatctgcgataattccctcttgttgcaagtaataatttgcatacacacggtcaatcaaaaggccatcaatacgatcgtttttcaagtcaatcaaggcttcattgaaggtcgcatactgacttgcatcgttattttgaacaatatctttcaaaatagctggttgtgattcaaatactgaatagccagatgaacctgcttgcgcacctaaaatcttatccttcatatcagatacttggctaatattggaagattttttggttacaagaacttgttggttatccatgtagggatttgtgaaaagaactttttccttacgctcatctgtaatagaataaccattccaaattaaatcaatattcccgttattcaattcagtttctttcaagtcccagtcaattggttgccattttacagtaattccatatttttcaaagactgcattagccaagtcaatatcaaaacctgtgtaagaaccatctgtctgttcaaatcccattgggacaaaggtcttatcaaagccaatcgtaacggatttttcagactcgtaggctgtccaattatcagacttagtagccgaatcattggagccacaagcagcaagagtcaaagaagttacaagagcaagagctccaagcatcatttttttaatattcatcatcatatttgttccttttcttagtgtttcggttcaattttgatgatttcatctgcgatattctcagcaaactgcatatcatgggtgaccacaatttgcgtgattccagtagccctattttcaagaatcagtttctcaacttcttttcttaattcagggtctagggccgaagttggttcatcatagccgataatctcaggatcaatcatcatcgcacgcgccaaggccacacgttgtttctgtccacccgataatgaaaatgggtaggcatttgcgtggttagcaagtccaagagtatccaagagtttaagggccttgtcttccgcctctgaacgcaacatattttgcgttttcataggagagagaaccaagttttccaatacggataggtgcgggaaaagctggaagtcctggaagacaaagcccagcaaatgtcgttttcccaactcctctaatggcagttcttgaccgttatacatcaaagttcctgaatcaatagtctctaaaccagccaacatccgtaaaagagttgtcttaccaccgccagattgaccaacaatggcaacaattttcccttctggaatgaccaaatcatagttggagaaaatctgtttatcttcaaagcgttttgacaaattgcgtaactctaacatgacttcctcctatctataataatcaaatttcttttctacttgtttagaaatcagtgttaccgcaccgatcatcaataggtagattgcacctgcgataaacataggtgccaagctggcatcacgattggccgcagtacgactagccaacaacaaatcgctaaccccaagtgcatagaccaaagaagtatcctttaccaaagtcatgacttcattgaaaacacttggcagaacaattttcacaacctgtggtaagacaatgtagcgaatggtctgaacaggggtaaatttcaataccttagcagcttcatactgaccttttggaatagcttcaataccaccacggaaaatttcagagaaataggccgcatagttgagcgtaaaggccagaatcacagcaggcattcggtcaaatgtaatacccacacttggtaagacgtaataaacaaaaattaattgtaaaagtaagggggttcctcgcataattaatacatagaaatgcaataaccattgtaagggtttaaatttaatctgcattaaaaaagcgaaaacagctcctaatggcaaggataatatcaatactagaaaaaatacttgcaaggagactgcagcaccatttagtagactgggcagaacttccaaaacataatccatagagctctcctaaaagaattattaggttctagtatatcaaaaaatatccttaatttcaaagaatttttcagaatttttaataaatttaacaaaattttgtatgttttttcattgatttgaaaaaaaggtccgaaatccgaaccttatcttcttattcaacagtaacagacttagccaagttacgtggtttatcaacatccaaaccgcgttgcaatgtcgcatagtaagcgatcaactgtgtcggaacaaccatagcaatcgctgataagaatggatgaaccgttgtaacagtgatgtcatcctcttccttagctactgcttcatctacaattgtcaagacattggcaccacgcgccaccacttcctgaatattgcctcgagtatggcttgcaagatgtggatgatttgaaatcaaggccaagacaggaacaccgtcttcaatcaatgaaatggtaccgtgtttcaattcacctgccgcaaagccttcacattggatgtatgaaatttctttcaatttcaagctggcttccatagaaacgtagtagtcactaccacgaccgatatagaatgcgttgcgagtggttgataagagtttttcaactttttcagcaatcacatctttttctgacaagctggcctcaatagattgagctacgatggacaattcatgcaccaagtcaaattctttcgcgtaggcattgccatttgcatcaccgacagccttcgccaagattgccaaagtcgcaatctgtgcagtgtaggcttttgtagaagctaccgcaatttctggtcctgcatggagcaacatggtgtaagttgcctcacgtgatagggtcgaaccaggaacgttggttacagtcaaacttggaatgcccatttcattagctttaaccaatacctgacggctatcagcagtttcacctgactggctaatcatgacaaagagtggctttttgctcaaaagtggcatactgtagccccactcagatgaaattcccaactctactggtgtatctgtcaatttttccaagaagtcttttgcggcaaatcctgcgtgataggaagttccagcagccaagatatagatacggtcagcttcttgtactgccttaataatatccgcgtcaactgttacctgaccagcttcatttgtataggcactaatcaatttacgcataacagttggctgctcatcaatttccttgagcatgtagtatggataagttcccttaccaatatctgacaaatcaagctcagctgtataactaccacgttcaatcgcattgccatcatagtccatgacttcaacactatcttttttcacgataaccaattccttatcgtgaatttccatgtattcacttgtctcacgaatcatagccatggcatctgagcagaccatgttatagccatcaccaagaccaatcaaaagtggagatttatttttggcaacatagattgtatctgcatccgcagcatcaatcaaagcaaaggcatatgaaccttgaataatcttcaatgcttttttaaaggcttctagagttgacaaaccttcttctgcaaattgaccaatcaagtgtacagcaatttctgtatctgtctgccctttcaagtcatgacctgcaagatactcttccttgatttctgcgtagttttcaatcacaccgttgtgaactaggatatgtccagcagtttgagaagtgtgagggtgagcattgttctcagttggcttaccatgagtcgcccaacgagtatgaccgatccctgttgtcccttcagtcttatcgccaacttttgcagacaattctgcaatgcgaccaacagctttcacaagatgagcttgctcaccacccgtcacaaaaatacctgctgaatcataaccacggtattctaatttttcaagtccttgaatcaaaatatcagttgcgtttgtatttcctacaacaccaacgattccacacatacatatcacctacgatgtttgttaacatcggctttcatttctttaaaaattggtctagtctaatttatatctaaaaagaccagtgaaatcagtatataacaagatttcatccttgtcaacattttaattggtctagtctaatttcaaaatacagttccagccatctcaatacaataaaaaaagctgattctactgaaccagccctgtcttaataaaaccaaattctgaaagtggactaatccgaaaagtcagtctaccaacaatagcctcactagaaatcaaaccaaaactacgactatcctgttgattcgttcgtacatcattcaacaccaaatagtgtccctctggaatgatgttgtactttccatttgtcaaggtttccaatgtaaagtcatctgtataactttcttgtgaatgaggcgtttttaaatagttctctgtaacaataatatcattacgatagagaacatcgtccatataggtaaccgtctcgttttccaatgcaatcacacgactcacatactcttttccctcatggttatacaaaataaaatctccatgaatcgggcggacatttcgcactgtcatgataaagtcattttccttcaaataactatttgccatctcaggggtaatcgtgactggctcaagtaaccaaaatcgtaggccaatgattccaaaaatcaataagaccaataaactgatttgttttattaaatctctttttaccataatctctccatttcactagtattataccacaatttagagccattagtgtctgagatgctggtaaatctcttcagcaataacttgatttcctaacggtgtcaaatgaagaccatcgctatagtattcaagatgtccctccgtcacagtgtaaaggttaataactggtaaaccaagttcgtttccgatagctgggataattttttgtaattcatcttcaataatttgattattcaatccaaaacgactggttggtacgtaaggcgggatgactaaataaacatccggctggcttggtaaatccatatactgctctgccatttccctatactcttgaataaacctctccctattccaatatggtcctcggctatcgttactaccaatcatgatgatgacaatatctgcttcactctcaagtgaaagttgggcattcttctctttaaagtaaggaaaatctgcagttgactgaagtgaacgcccactcaatccataatttgaaacttgatagtgatgcccaagtttctcagctagaatacaaggataggcatctttttcccgattctccaagccatatccataagtcaaactatctccgactgttgcaacttttacggccccacttccaacagttaggacctcaggatacattatatctgacacacgaactcctcaatttttcttattttctattgtatcatgttgaaaaaaataaataaacttctgaatttgtgatataattaacttatgaaaaaacaagttattattataggcggaggaattgttggctctactgcagccttttatctctcccaagaagaacaagtcaatcttactctcattgattcaggggtcggaacagccacacgagctgccgcaggtatcatctgcccatggatggctcagaaaaaaaataaagactggtataagctgacttccgatggtgctgttttctaccgtcaattggtagccgatttggaaaaatcgggtgctactgaaattccattcaaacagactggaaccatcggcctaaaaagtaagcctgaactacttgataaaatccaaaaaattgccgaggaacgtcgcgtagatactccgactattggcgaaattactccgcttataggctcggaaattaaccagtacctgccactacttaagccagactattttggtatccatttagaaggtggcggtcgtattgatggtgggcgtttgattgatattcttcaggaacaatttttgaaaaatggtggtacacgtatctacggacaggcaaaactgctcgacaaccatactgtcgaagtagataatcaagtgcttactgctgaccatattatcttagccacaggggcctggttaccacatattcttgaacctcttggctatcaagtggatgttcgaccacaaaaaggacaattgttcgaattagatacagaattcgataccgacaattggccagtttgtatgccttacggagagattgatatcctaccatttgaaaatgggaaaatcattattggtgcaactcatgaagatgacatgggctacgatttagaactagaccctgaaaaaatccaagccatgcatgataaaatagctgaattcatgcctgatttggcaaactatcctgtaaccagaactcgcattggaacgcgcgcctatacttcaacttattcaccattctacggaaatattgaggatatgcctaatgtctgggtagctagtggtctaggctccaccggtctgacaaacggtccaattatcggttggcaaattgctaaagaaattctcaatcaagaaacaaactttgaccgtacaccatattctccaaatagatatattctcaaaaaataagatacgatacgtttagattctactaaccctttaaatgtagatactaagactagttgttatctaaccaataaatacaataagcaacggggaacctcgttgcttatttctatctagaatactaccattctagtctcaaactattaaaggattatctatagcatgttatcgcaaccatagaaactgattcacttaaaaacctaattcgttgaaaatatagtcttttagtttacttttagtactaggcaacgagccgcaggcataactggagttaggtaaggcgagttaacgaagtaataaaagaaaaactaaatgacgatacttcttttacttacgtcttttctttaacaaacctaaagcactaccaagaacaagagtcaatagaccgactcccataatctgtcttgaagtaggtgtacttactttcgaagattgttctacgcctaaaatttgttttgcacctgcttgagattgaactcccatattcttaccagattcaatagtattatttgaggtttgtgagatattttctacgagcactacaggctcagaagcagatgaaaccgtttcaactaactctgtctccttgtgttccataacaatttctgctttagacacctgacgctctgtattattagactctaataacacagtattctgatagctcatacctatctcagtactatttgagtttgaagactgagcaatggtggcttctagcaatggagaccctgcttctgctaagcttgattctagcaattctttcttaataacttttgattgaacagagattagcccgtcagtatttgtttttctaacctctcttttcgataatgaagaaacttctacttctgcattcgtgtccctcttagaaccgataagggagatagctactggttcaatcactggattatccagattaactgatgaaacagcagttagagaggcatctgcatgaatttcagaattgtcgacagatgcagcttctacattagttgatttgctcgaggttggttctgcaatttctgtatttccagtctgaatggagtctttttcaagcggagtggctacagattcagttgtggaaccatctgcatatgccgaggagccacagggagtaactgaagaggtagctgcatgaatttcagaattgtcgacaagttcagcttcaacactagttgattcgctcgaggttggttctgcaatttctgtctctccggcttgaatggagtctttttcaagtggagtagctacagattcagttacggaattatctatatacgtcggggaaccatgaggagtagctacatcattaacaggagtgaccacagtttcagtttcgacattcgttgattcgctcgaggttggttctgcaatttctgtctctccggcttgaatggagtctttttcaagtggagtagctacagattcagttacggaattatctatatacgtcggggaaccatgaggagtagctgcatcattaataggagtgaccacagtttcagtttcgacattcgttggttctacaagagagatttctacattttgatgtggtattgagtctggttgttcagaaacaaccgcctccactctatcttcttctttgtcatttgcactctctacgattagggtgtctgacagaagttccgaactctgattttcaactttttctgattcaagaagctcttcaacttgggctacctcatcatttttcacatcttcttcaacagctactactagcgaatccgtttctgacgtttgcatgtttcttgatagttctgaaccaaattcatccttgttttcaataattattggtaatgtatctgcctcttgttcaaaaacattatctccctcagcctctactgaagatgtcgtttgggcctccactggaaaatgcaattgattggtaccatctgcaataatacctgcattctctgtgtctgcttccaaatttgtggaacttgtttcttgagatgatagagaatcaacatctgaaaccgttgagcgatcacctactggtaaatctggtgccaaagcatttccaacttctgaaataggaaaatctaaactctttaaactatttaaaccattttccaatgcaccacttagcatctcagaactttctgccttttgaatagatagaattccttgattatagagattatttagtttttcaagataaatcagtcgcattgattctggcaattcagattgtccttgaatagacaaatccaacgccttctttgtatcggctaatgtctgactagctgtttctttggcttttgcaagcggattgaaatattcttcccataagtcttgacccagacggattgtatggacataatccaaaagcgctccagctgaattatttttcatatgattattcaaacgtggatttccggaagcatcacgagtgattcccatacgcttcaaaccaatttgttcttgttgatcatcagaatctgtgatatagacagccttaatcttaccttgattgtcgtactcagcaccccataccgtcacaatatgcgttgcataacctaatgttctataagttaagccgagtaatcctttgctttccaaaacagttcgaacatcctcaccaaaccgctcataactaccactaaaaattcgatttgtcagttttttctctttgaaaacgtcgtagaaaaagccacccctactatctggtactaactggctatcttccagattgacaccgccctgtgccttaggtttatatccgttaataaacaagtcaaccaaggcatctgatacaaaaccatttgtacgataaccatagtaagttttgaacatatcaaaaactcgactattttgttgattttggaatgaattaatatagcgccgtaagtccgttattgcgtagttttcttcaacatttactgtaccctttttttctttgagatatcgctcaacataggaactattctgttccaaccaccaatgtaccatgtttgaagacacagctgcaaaacaaagattaaggtcaataaatgaagcattcagactcttattggtatcatagtagccttttccagcctcaaatggcgctgtatagtttaaatagtctccatacttttcctttacaaaaccaccgctttgttccattgcaggaggagtaattccatgggcccatataatttgtcgttgctcgccactctccgtttgataactggtctgattcaaaatttcttttgtctcagtaacctctatctgattttgctcgctcgtcgtaacttctgtatcatttctagaaactacattctcggtccctctgtcaactttcatctctaccgctacttccccttcagcgataacaggtgatgggatgttgtctgctatttcctctacaatttcaatattagaaccatctagggattcatttttttctgattcaatagatacctcatccttgacttgtgattcttcaattatttcattcactcctgtaacaactgtatcggcagcaacagtggatgtataaatagcacatagcaaagagactgagaccaagccaaccgcggattttctcaaagaaaatcgttcttgaatgttcatctttcctccgtttatatttatattctttgaacaagttattcttactcttatttattttttatatcaacatcccaaaatcatttagaggcaaaaaatctataacagcacgtatttaacttattctctaattactacaaaaaggtccaagcggacctttttattattttactgtacgaacacgcatagtatttgttgaacctgcaacacctacaggcacaccagcaacgataataatgtcatctcctgcttcaacaagaccttgctctttggcaatacgttcagccaaatcaaacatatcgtcagttgaatctggacggtttgttacaattggaataacaccccagttaagcatcaatgatttttgtactttctcagtaaatgttactgccaagatgtccgcatctggacggtatttagagatcgaacgagctgagtaacctgtttctgtaactgttacaactagtttgatgtccattgagtgacatgcgtcttttactgcagaagcaataacttctgttttagaggcacgattaaactgatcagatttcaaacgaccatattcattaagaagagtctgtgcgtttttagcgatagttgccattgtacgaactgattctactggatatttaccgtttgcagactcgcctgaaagcattgttgcatcagtaccgtcgataacagcattgaatacgtcagatacttcagaacgagttgcacgtggtttttcagtcattgtttccaacatgtttgttgctgtgataactgctttaccagctgcattcactttagtgataatcattttttggtaaactggaaccatttcgaatggtacttcgatacccatgtcaccacgagcaatcatgataccatctgctgcttcgatgatttcgtcgatgttgtcgataccttgttggttttcgattttcgcaaacaattgaacgtggtcgttaccagtttctttacagatattacgaacaacttctacgtcttttgcagtacgtacaaatgagatagcaataaagttcaaaccttgctcaagaccgaagcggatatctgcattatcacgctctgcaagagctgggaaaggaatttttgtgtaagggatgtttacacctttttgtttagcaattacaccgtcgttttcaaccaaaacaacaaattcacggtttactgcatctttttcaacaactgtcaaaccaagtttaccatcgtcaacaaggatttgcttaccaacttcaacatcgtcaaagacatccaaaccacctgctacgttcaaagcaatcacttcttttgtagatttgataccttgttttgtagcaacacgcaatttgtcaccagttgtatatgcgtattcttttgcatcatcttcaaacaattctgtacggatttctggaccttttgtatccaacaagaaacctacttttttaccagcgatttcttctgcacgacgaactgttgccatacgatcaccttgctcttggtggtcaccgtgtgagaagttgaaacggaaaacattggcaccttctgtaatcaaagcagcgattttctgtgctgatgactcaacatctaatttttcaccccagtaaccatcgtcaccgaattttttaccaccgcggatttctaccgctggaccaagggttgcaacaattttaacacgtttgttcatcttaacaaaactccttttatttcaatggtcatatgacccttaattaacacttttaaacaatgatacctagattgacaagttacggttcaaatcagccaactccaaatctgctttatgcggattattaactacaatcttgccatcagtagtcaagctaaacaaggcaccttcttctgcagttccaagaattggattttcaaccatttgctcgttacggatacctaccgcaagacctccacggccttctttaagcaatttaacggcatgagcacccatacgagaagcgagtacacgatcacgcgctgttggagaaccaccacgttggatatgaccaagttctgtcacacgaagatcacttgtatcgcctgctgctttcaattcttcagcaaactgtgccgctggcataacaccttcggccaagacaatgatgctatgtttcttacctttatcgtagcccgctttaatgcgatcaacaacatcgttgatattgaagtcttcttctggaacaacgataacatctgcaccagaagcaataccagcccaaagagcgatgtctcccgcatgacgtcccattacttcaacaacgaaagtacgacggtgacttgatgaagtatcgcggattttatcaatcgcatccatagcagttgttacagctgtatcaaaaccgattgtaaaatctgtacccacgatgtcgttatcaattgtaccaggtacaccaatagctgggaaaccatgctccgtcaagcgcattgcaccgtggtaagaaccatcaccaccgataacaactacaccttcgataccatgttttttcaattgctcaatccctttaagttgcccttctaatttggcaaattctggataacgagctgaacaaaggaatgttcctccacgtgaaataatatcacctacagaacgtgcagacaattcatggatatcacccgcaaccatacctgcgtaaccttcgttgattccataaacttccattccttctgaaattgcttggcgaacaactgcacgaatagcagcgttcataccaggggcatcaccaccactggtcaaaacagcaatacgtttcattcgttaatgctcctttaacttttcattttaactgccctattataacatacttagcctaaacttgcttgactttttgctatttttttatcgaaaaatcgttttcataacaaattcacttaactcttcttctaattgaggcgttttcataaccatgtggtgctcagcctgaattgtctgattactatcttgataatgaagtactactggaatgcttcctctatatttatccaaaatacgagcaacagcataatcgtgttctcgattttccaaaagaatccaaaatttctctaaactgacaggctctaatttttctagaactaattgcaactgtccatcccgctcttgcactctacctgtgatgtaccccattcccccttcttccaaaatagaagcgtattggcgataagattcggggaaaagagtcacgtcaagcgtcctcttggtatctgtcactcgaagaaatgccatctgctccccagtctttttggtacgaatcaatcgaatagcttgaatctgcacaagaacggtcgctcgattgccaaccgctaaatcagccaaatctgtaaaactacgcttagactctcgacaaatattgactaaaggatgcggactaataccaacacctagcaattcttgctctagcataaatttttcactgtcgctgtaatcttctacatctgtccaactataactctcctctgcaaaaaatgtaccaattgcctctgcaaagacaaagagattgtctagattttcaataatcttttttcgattggcgtcaaaatcatcaaataaaccaatctgaataagagggattagtaaatcctttttcttgaaattatctggcaagcgcaaaataaaatcttctacagacttatagggacgatgatccaatatccataaagctaaatctttaggcaaacctttcagtgtttttaatcctaggtaaaccttacttttatcaaacttatcgtgataaggaatattgttaatcgtgagtcgagctacctcaaagtcaaactgcatcgcatcttcaatataagcactgctagaatgattgagcatgacatcaaaaaagacatccgtatagtgactcttgaaataggccatttgaaaggctaaggctgaataagcataggcgtggctacggttaaaaccataaccagcgaacttagccatcatgccaaatatttcccttgcattctcttcagcatgtccgtttttcagtgctccctgtaaaaattccgcttccattgcctgcatttcctgcgcattctttttagacatcgccctgcggagtaaatccgccttgccaagcgtaaagcctgcatagacctgtgcaatctgcatgacctgttcctgataaagcatgataccataagtcggttgtaaaataggagcaatggttggatccaacaaatcaactgtctcttgtccatgtttgcgttttacaaagttatccgaataatcactagcccccggtctattcaaactcgttgttgcaactatatcttcaaatcgaccaggtttgacccttcgaagcaggctaatcgcaccaggctgttcaaattgaaaaattcccttagtccgaccagcagcaaaaagttccaaggttttcttgtcttctaaatctatcttggcaatatcaatttcctgctgataacgttcacgtactccttctgccattttttgcacaaaggtcagatttcgtaagccaaggaaatccattttcaacagaccattcgcctcaacagcatgtgcatcatattgggttaccagcatgtcatcccctattttaagagggatggtatctgtcaactcctcatcactcatcactatccctgctgcatggatagaagtctgtcggggttgcccttcaatttgttgagcaatcgcaaaagctttttggtactctatcttactattgataatctggcgaaaagcggcatttcgctgataggcagaagtaagactatctctaaatgaaattttcttggtaatattacttaactcatattcaggtgttccgaaacgcttaaatacatcacgaatagcctgcttagctccaaatgtcgagtaggttacaatttgagcagcatgggttgaaccataacgatctcgtacataacgaataaaatctgctcgatgaatatctggaatatcaatatcaatatcgggcattgaataacgttcagcattgagaaagcgttcaaagagaagattatgcttaacaggatcaatacctgtgatatttaaggcgtaggcaactaggcttccaacagctgaaccgcgccccattcccatgtagtacccttggctacgtccaaaacgaagtaggtcccatacaatcaagaaataatcatcaaattccatttgatgaataatggataattccttttccaagcgttccttatacagtgaattagtcaagcccttctcttctaatccttgataggagcgctcgtataattcttccactgcaggtctgtcacgattaaaacgcggcaattttaaatctgtatttaattgataagaaatccctgcaaccaagtcacgtaaattatcaactgcttgcggaaaccgattagaaaatagattggttaagctatcagccgataaaagcttttgccgactatctacatctgaaacctgattaagcggaatattatctcgaatagcatggagaacctgtagactttccaattgttcctcttcaaaaaaacgaacagtatggattggaaggggtgcttgcttaaaatcttgaaccggtgtgtcaactgtcactccgatataatagtttacacccaactcaaggtgctcaatgccagaaaaataaggaacaaccactgctatgtcgactaaatattgacgaatagtttcaaaatcatcttgccctgtcatcttagcagtcgaaattttcaatagattgcgataacctctggttgtcagagcaatcaattgagtagtgatgtcctgctcctctccctgtaatttccagtccagttcacaaccaataattggttgaagccccattttgttacaggattccataaaactataggctgcataaagactgtttttatccattatccccaatgcgtggtaaccaagctctttagccctgcctacataactctctatcgtcaccatgctatccataaaggtataaactgtctttgtatctaattgtgccagcatggtattctccttttcatgtttcttctattatatcaaatatttatccaaaaatattttttaaaaattcaaaacatttttcttgctaatttatatagtttattgtattattaagataagacataaacacggtgtcatcctagaaaggaaatgattatggcttggaaatttgataataacatccccatctatattcaaatcagcaatactattaaattgcagattgtgactaatcaattaaaatctggagataaacttcccactgttcgtgacttagctgaaattgctggcgtcaatccaaataccgttcagcgcgctttgtctgatttagaaacagaaggatttgtttactcggttcgcacaacaggtcgttttgtaacagataatcaagaattgattacacaaactcgcctacatttagcccaaaaggaactggagaacttcgtgaacaatatgttagaattgggctttagacacgatgaactcactagccagttagatgattatttgaaaggagttacttatgagtaacgcatatactttggttgagctacagcaagtttcaaaatcttatggtggagctgtcgccctaaataatgttaatttgaagttagctgccggaaaaatcataggacttttgggaccaaatggttcgggtaaaacaaccatgattaaattgatcaacggcctgttgcagccagaatatggtcaagtattgatcaatggtcgcacaccatcgccagaaaccaaggcgattgtatcttatctcccagataccacttatcttgatgaacatatgaaagtgctcgaagcagttacattttttgaagatttttacgctgattttgataaggagcgtgctctccatcttttacaagatttgggtattgatttaaacagtcgtatgaaacatctctccaaggggaataaggaaaaagtccagctcattctggtgatgagccgtcaagcacagctgtatgttttagatgagccaattggtggtgttgaccctgccgcccgagactacattttaaaaaccatcgtcaacaactattctccgactgcctctgttattatctctactcacttaatttcagatgttgagcaaattttggacgaggttattttcctacactacggaagcgttattcgccatgggaatgtagatgacttgcgaattgaaagcggagaatctattgacgaactcttccgccaagattttaaggcttagttagaaggagattgctatgtttaaaaaattattgaaatacgaatttcaatccgtaggtaaatggtatttgggaatttatattgcagctgtggtcctatcagcagtacttggtttttggctacaagcgttggccctccgtacacaggctggaaatactgaacctggcggtggagagatggtcttattgggaacatcctttatgacttttggtattttaattgccgcactcttcttgtcaacatttgttctagtaatcaaccgttttagaaaaaatgtttatggccgacaaggttatctcactatgaccctgccggtatctagccatcagattatcttaagcaaactacttgcctctattgtttggtatatcttggcaggtattacttgcttactttcaattggaatcatccttgcagtcattctagcagcaagcgaagaagctattatgccagaaatacaaacttttgttcaagctatcgactggacaattctattcagtcagattgtctattatttaattgaaattaccactggtatccttttgatctacttctctatatctgtcggtcaattattcaaggatcatcgcttcctctttgcaatcttgacttatatcggcattctcatcgttactggagtatttagcactttctttgtcctaagtaacctaggaacagcttattctacaccattttctctctatccaagtccagtcttagcattagtcaatattatcctagcttttgcttactactttggaacccacttcattatgacaaagaaattaaatctacagtaaaaagctctttactggtctaatcgaccggtatagagcttttttcttaatactgttggtctaggagttccaacaaaactttcttttcttcttcgctggcaaaacttgcctgaatagcattttgattgaagcggtaaaaatcagctttgctagtcccaaaatattctacaaataactgatattctctattaagtgtagtattagaaacggtacgattatctgtgttgattgtgatgtttgctcctgcctcaactagctcacgatatggaaaatattcaatcgaatcagctgcaccagtttgaagattcgatgttaggcacatttcaagtgttgctccgctattgacaaaagcttggatagcttcaggattgcgagtaagtgctgtgccatgaccaatccttctaatcccaagttcaagagcttgaatcacattggtcacacatccacattctccggcatggaaagtcatgggataacctaaagactgagtaaattgaataatatcccgaagttcttccgtaggatagtctgcttcatttcctgcgaaatcaaatcccacaagtccttttggtgccaaatcagcaatagccaaaaagagttccttcgtttgattcgtattcgtttgctttaaaccacaaaccagaagtttagcaaccactccaaaatcttcctgccccctgtttagtccaactaaaactgctgagaccgcttctaaaatagtcaagtcttgatccgtcgacagttctggtgcaaaacgaacctcaatgtaaatgaccttatcacttgcaacttgtcgtacaagatcataggctgccaattctaaagctgttgcagtttgtaagagtgggcgaacaaaatcaaataactttaaataagccattaaactatcaacttttccatgaacactaactaattttcttaatgcttcatcttctgcaggaatagtgattttagccatctgtgccaattgtcgaatgactccgagggacaatgagccatccaaatgacaatgcaattctgttttgatcaattcatttacattcaacactattaacacaacctccgtctggtatattgttaactatcatatcatatttttgaagaaaaacaagaattttaccataaaacctgaactttcatttgtttagtaaattcccaaagtaagttctagtctgtcttaaaaactggaaattagactgagacaaagaaataaggtagaacttactatgggacaagttggtaactgacaatgaaaaacaaacacttaactctctctgatcgcaatgatattcaaataggaattgaacaacttaagcccttctcagctatagcagctaagttaggaaaagatccgtccacaatttcaaaagaagttcggagaaatagggtgataaaagagaactctagtacctccaattgtgaggcctgccctctactcaaaaagactccttacgtttgtaatgcctgtccgaaaaagagaagcaactgcggataccagaaacagttctactacgcaaaaagagctcagcttgattatgaagttaagctctcagattcgagaacaggtgttgcactaaacaaggaagaattctatcgcatggatgagattgtttctgctgccatccaaaagggacaacacctcaaccacatcatcgcctcaaacgaaatgtcggcatccagagcttctatctaccgataccttgaaaaaggctatctgtccacaaagcccattgatttcccccgtgtcgtgaaattcagaaagcggagaatcagaaacctacaacccattcctaaaatcgccaaagaaggacggtcttacgaggacttccaacgctttctcacagagaaaggaatcagctattggctggaaatggacaccgttactggacggatcggcggaaaggtacttctcacctttaacctctccttctgtaactttatcttcgctcaattacttgataataaaacagctaatgaggtcgctaaacatctctacgctatcaagaatgacctgcatcagaaagagatggacttttgcgaaatatttcctgtcattctgaccgataatggcggtgaattcgctagagtggacgatatcgaaatggatgttcgcggagaatctaagctattcttctgtgaccccaatcgttctgaccagaaggggagaattgagaagaatcacacacttatcagagatattcttcctaaaagaagttcttttgacaacttgacacaggaggacatcaacctggtttgttcgcatatcaacagcgtcaaacgagcttctttcaacggaaaatcagcctatgaactctttacatttacctacggtgaggaattggcaacacttttgggaatctctaaaattgaccctgagaacgtcattcaatcacctcgattattggataagtaatcgctagtttttatcaaaaaataatttcaaaatagaaaggaacttgttccatccaaaattccagatagctagaacttactttgagacgtctcagagccagtaactttagtgtactcttttttcaacattttcaaccctaaaactcactattatcaacatttttagtcaaaaacagaacttagtctgagactaaattctgttgatgttatgcagttttctcagagtaacttctggaaggacgggaactagaacttactttgagaatttaccctttcatttgttttcagttgtatcattcacagacaaaaaaagaacgactatcagtcgttcttcaataacatacggaagacatgggattcgaacccacgcacgctgttacacgcctaccgcgtttccaacacggcctcttgagcctcttgagtaatcttccatatatggagctggtgggaatcgaacccacgtccaaacacctgctaacttattcgtctacaaccataggttatgtcttgctttaactttaacttgaactcgatacataactcaaacctagaccaagcgagtcagtaaatctcttttggaactgcctgactcaatcccaacgtagcttgctattttaagaccaatcagcaaacacaagcaattcgcgactggtcacgcaggcaggttattaagctgctaatgcgtaagtgtttgtattttttgcagttatatttaactggcatttttacatctgccgatgagttgcagaacaagcctcataatgcctgtcgaatccgtaacaaccccgtaggatttgatacaggaattattatagcagaattttttataaatagcaaaattattttacattttccttacaatttaaaaaaattttgaaatatggtaaaatgaaagtatgtataaattttggcaaaaaaccattcaagtattaagtattttgacccttatcgggaccgctatttttctattttggctctataagattggcattttgaacgaccaaaatgtcttaagcgatttaatcaaaagccaaggtgctttaggtagcctctcctttttagctattcagattattcaagttgtatttccgattattccaggcggtgttacgactgttgtgggtttcctcgtatttcatttttggtggggattctttctcaattatcttggaatttcaatcggtagtatcatccttttctggttggctcgtcgctatggaaagaaattttgtctcctcttcatgtctgaagatacgttttacaaatatgaaagcaaaattgataataaacgtagttatgaaattttctttattctctgcatgctttctcccatttctccagctgacatagtggtgatgattactggattaacaagcatgagttatcggaaatttattatgattactttactttgtcgccctttctcagttgtggcctatagcttcttttggatctatggcagccaatggttgcagcaattgttaggataaaatcataaccacccgtgaaaacgggtggcttgtacaccggctataagccgtttctctccagcgacgtctaaagacgttcgctgaacttcgttcaggttagtgctataattacttgactaatgcccgtaacaacgggcttttatcttgttctaaaactactatctgaaaatgaatcttcatattctttaacacttaacttatcaagtgcgatgtcatttttctcctgctcgcgaatatatttcgctaccgtcttttcgttcagtccaacggtactcacatagtagcctctagcccaaaactttcgatttccatacttatattttaaattagcatgtttatcaaatatcatgagagcacttttacttttcaaatatcccataaaatcggaaatcgaaagttttggggatatcaagacaagcatatgaacatggtctggcatcatgtgtccctcaatgatttccaccacaccaaacgcatgaagaaaaaaacgttttcagaaagcgaaaatcataaccaaagatcaatcaaagtagtacactagaatagaggtgaactacaataattgattttcttttatccatagaagagcacaaagaggagtacaacagccgtcaagcatggaaaattcgttatcccttatccactattctgtttctagttttcgcttgtcaattggcaggggttgaaacgtggaaagagatggaagatttcatagaaatgaacgagtctgttttgggagaatacgttgacttgagtgtcggctgtctttctcatgacaccttggaacgtgttgtgagtatggtcaatccagatttcttaaaggaactgaaactgtccttcgaagctagttcggaaacaactgatttttcaaaattgattgccgttgacggaaaaacgattcgggggaaccgagggaaacaccaatctcctactcatattgtcactgcttatgatggtggtaatcggattagccttgggcaggtagctgttgaggataaaagtaatgaaatcacagccattcctcgcctcttgtgtcagctagaccttcgtaagagtgttgtcacgattgatgccatgggcacctagacagacattgcggatgtgattatcagcggtaagggtgattattgcttggcagtcaaaggaaatcaaggcaatctccatgaggatattgacctctattttagtgacgccaaattgttatctacgttgacagagaaaggctgtcattatcagaccattgaaaaggcacgcagtcagattgaggtgagggactactgggtttctcacgatgtgaaatggctgagccaacgacatccgaaatggaaaaaacttcgtgggattggtatgactaagaatatcattgataaagatggtgtcatcactgaagaggtccgttactttatccttagtttcaagggcgatgtgcaaactttttctcaggttgttcgtggtcattggtcggttgagagcctacattgattgttagatgtggtttaccgagaagataagaaccaaaccttagataaacgagctgctttcaatttaaatgctattcgtaaggcttgtcttcatctcttacaaatgatgaccttccctaaggagaaattgagttaccgccgcaaacaacgctatatttctgtccatttggaggattatttgccacaattatttggaaatcggggataaggtgcttgtaaaaaggtagatactaagtttaaagcagttatttccggggacaaaaggagagaagaaatttttcatgcgtatgacgtgatgtccacgcctttgcatcgacatagatgacggaaaatatcaattaagtcctgccttattttgtagtaaatggattttctacggtacttaggtgtgaaaactatgtgatagagcacatccatttagtatgtgataaactgtaactggttttagccatttctttttcctccttgatctaacctgaacaattagattataacaggaaaaagaaatggaaactcaaagccttggcagccaccagcatagctggtggctttcttgtttttctctacgagaaaaactggctcgaagccataataaaaaaacggcttcaaacgttcgaaaccattttgtttttttatttaattcctaatgcaattcgagcataacgactcattttttgaacggtccaagctggtgaccaaaccagtctcacatctacttctgttacttcagggacatccttcaatacatcatgaatttgatcggtaattagatcagctaatggacaacccatggtcgtcaaggtcatatcaatttcagccttgccctcaataaatcggatttcataaattagccctaaattgataatatcaatacctagctcagggtcaatcacatcttcaagagcatgaaaaatacgctcctgaatgtctttaatttgatcttctgtgtacgtcatttttctctctttctttttcacaagttcaatactagaaaagaaacaaacgaagtttgtgtcaaaaagtccactggacgttacgctccctttctaatttcaaggggagcggttaaaatctcgctcgtttcctgttttcagcgagcggttgattttgtctcccagacaaaatcaatcctcaataaaatctcttagtggtttgctgcgggatgggtggcggagtttacggagggctttggcttcgatttggcggatgcgttcacgggttacgttaaagactttaccaacatcttcaagcgtacgcattttaccatcatctaaaccaaaacgaagacgcaatacgttttcctcacggtcagtaagagtatccaatacctcatctaactgttcacgaagaacgacacgagttgtgtaatcaactggattttcaatgacttcgtcttcgataaaatctccaagatgactatcatcttcttcaccaattggggtctcgagtgaaacaggctcttgggcaatcttgaggatttcacgaactttctcaggcgtcatatccatacgctcagcgatttgctctggagttggatcttggcccaattcctgcaagagattgcgttgttcacggaccaatttgttaatggtttctaccatgtgaacagggatacggattgtacgcgcttggtccgcaatggcacgagtgatagcctgacgaatccaccaggttgcataggttgaaaacttgaaacctttagagtagtcgaacttatcaacagccttcatcaagcccatgtttccttcttggataagatcaaggaactgcataccacggccgacatagcgtttagcaatggatacaaccaaacgcaagttggcttcagccaaacgttgtttcgcttctgggtcacctgcctcaaccgccaatgccaattcttgctcttcctcgttggtcaaaagaggtacaacaccaatttctttcaaatacatgcggactgggtcgttcacttttgcagaagtgcttccgagcaattcttcatcagataattctggttcttcctctacctgcatagcacgagcagaagggttcccttctttatcaacaatcgaaatccctgcgtcctgaatacgttggagcaaatcatcgattccgtcagcatcaagcgtaaatggaataaccagttggtcattgatttcatcgtctgtagctgaaccttgttttttatggttacggataaattcggcaacttgtacatcaaaagtagttacttctgtttttttatcttttttatttgtcatatttactccatttgtcttcttctatcgaggagtttttgcaactcatcgagggcaatatctgcatttcccacatgggaatgttcacggattttccgtgctaggtgctggttctccttctttaacaattccttgtctcgccgaatttctaattcttcgatttcgtgtggagacacttcatcaggtaaacgttcttcctgcatacgataccaagcctgttgagcggaatcgttcaactgtgatagttcaaaactggtaatttccccagatttttttaacatatcataaatagcttgcaattctggcgtcgcaaaataaaaatcttctcgtaaacggaactcattgagaatataaggatgttcaaccatccgataaagtaaatggttttctgttcgaataagactcgttatacgagcaatcgtttggactggtggcaaataagactgaccagtctgtgattgaaatacctgttgtgttctctcctggcgctgattcagacgaacagcatttactgcctgttccacctgattataatcaaagtcagaaagtaaatccgccaccttataaatataagaattttgagctgtaatggatgatactttggcaataattggtgcaatcttatctacaaactcaatctgcatttgtagattgtcaggattttcaggtttcaagtattgaatcaaaaattctacatcgctgattcgtgacttggttaaaacctgttgcaaggcttcttccgaatttttctgcaaaaattcatctgggtccatattatctggcaagctcacgatttcaacctgaaaatcttgtagttcgtccaacgctttcatggtagcagcctgtccagccttatccccatcataagtcagaacaattttcttacaaaacttagctaggtgtgcaacatgctctcttgtcaaagctgttcccatggaagccactgcattatcaatccctacacgatgagcagcaataacatctagaaaaccttccatgagataggtttcacgttgcttcttaataaccgctttagccttgtccaaatgatacaattcatagcttttattgaaaatcgcagtactacgagagtttttatacttggctaattgtttattgtttcgattttcttcggtccaaatccgacctgaaaaagctacaattcgaccatattcatccgccaaggggaaaataatcctcgcttgaaaggcgtcataaataatattattctcacttggattgaacaaacccgaattcaatagactttcttcgtcatattgacctgatagtttttggtaaagaatattctgttcggcaggagctaagcctagctggaatgtttttatgacatcatctgtcaagccacgttggtgtagataagctctagcttcctcacccattttagttgtcatcaaaagggcatgataaaactttgcagcatcccgatgaatatcatacagtacctgatgcggactaacccttttctcctcttgatgataggaaggagttacatctatttgaaaccctgccttctcagctaagatagctgccgcatctgcaaaagaaacaccacgaacttcttcgacaaacttgaatacatctccggacttaccacatccaaaacaatggtagaactgcttatcttcaatcacattgaaagatggggttttctccccatgaaaagggcaaagaccgacataattacgtccggccttagtcaaagcaaccgtttcaccaataacatcaacgatattgagagcttgttttatttcagtaattttatcctttgaaagcacattccctcctcatatcatactagctaatttaaaaagtgaacactctccccttagtttaacatactctattgtatactaaatatgggaaaatgtaaaatttctaaaacaaattgcttgtaaaatatttttttatgggtataatagataaagtaaaatatttatgaaaggacatatttaggatatgttgaaagatttaaaagcatttttgttccgtgggaacattgttgaccttgctgtagcagtggtaattggcggagcgttcggcgcaattatcaaatcatttgtaaatgatatcatcactccattgattttgaacccagctttgaaagcggcaaatgtacagaatattgctgaccttgcatggaatggtgtgaagtacggtagtttcttgagcgctgttattaacttcctaatcattggcacttcaatgttctttgttgttaaagcagctgagaaagcaatgcctaagaaagttgaagagaaagctcctgctggtccaactcaagaagagttgcttgcagaaatccgcgatttattgaaaaaataatcaataatatattgaaaaacaggtctccatacctgtttttctcttccataattacaaaaataagatgtgagcctccactcacatcttttcttatccttcgtatccatttggatttttcgattgccagttccacgtatcttgacacatgtcttcaattgttttttctgttttccaatttaactctttccaagccttgtctgcgttggcgtaacaggttgccacatcacctggacgacggtcaacaagtttatagtgtactggaacgccatttaccttttcaaaggctttgaccaactccaatacacttgttccttgacctgaaccaagattgtaagtatatacacctgtagtagttgaaattttttcaagcgccttgatatgaccgagtgccaaatcaatcacatggatataatcacgcactccagtaccatcaattgtatcataatcgttaccaaaaacgctgagttcctcacgtttaccaactgctacctgtgcaataaacggcatcaaattattaggaataccagctggatcttccccaatcaagccagattcatgggcaccgattggattgaaataacggagcaatgcaatactccactccttatctgctacttccacatcacgcaagatttgttccaacataactttggtatagccgtacggattcgttgcgctagttggcatagtttcaaccaaaggcgatggattattgagaccataaacagtcgcacttgaggagaagacaattttcttaacactaaattctgtcatgacttctaccaaagctagggttgacatgatattgttttcatagtacataattggcttagccactgattctcctactgccttgtagccagcaaagtgaatggctgcctcaatgttttcattttcaaaaacttggcgcaaggcttccttatctgccacgtccaactcatagaaagttgggcgcttgccagtgatggtttcaatgcgatctaaaaccaaaatacttgagtttgaaagattatccacgataaccacttctttccccaacttcaacaattcgacaaccgtatgactaccaatataacctgcaccaccagtaactaagatactcatctttttactccttttcacctggacaaaattctatatccctattatatgttacctgttgtaaaaagtaaacaaaaaacagcctttcggccgttttcaaattcaattagaattttttacgcttgcgagctgcttctgatttacgtttacgttttacagatggtttttcgtagaattcgcgtttgcgtgtttcttgaagagtaccagctttagtaaccgcacgtttgaaacgacgaagagcatcatcaagtgattcgttcttacgtactactgtttttgacatttttttcactcccctcaatttcaaagtctttatcattttactatgattcaactcatttgtcaatatttttttcattctaaaatatgaattttacgctcttatcctatcctattcttttttcctgtccacgccagtattgtccaaaagaagaattcgtaaaggacaaaaaataatacaaagcaatgcaagaaaaactcttggggcaaaatatatatgacaggatcctttgcagggtcaaatagccatgtagaatctcctggaaatagcaccgtatgaaacaatgcaaaaaactgatcaaagccaacaagaactcctaataaaccgattatcattggcgtaagcatggtccagaaaatgacctttttaaccaagtctccataaccttttagcagaatgttttttacaaaaagcacaaaggcagggagggtgaggataaaaattccctgagttagatggaataaatgtttcacatccgcaaaatgtttcagaccatcagctgaggatgaaaaatttggcatgtctaaaacacttgcaaaaggatttgttagatagttcatcaggatattgaaattgtaggaaatatctgccaccttcatgtagaccactttttccaaccccaaaaaagaaatctcaagcggataaactagccaagctaggtagatggttcctagaactgctgccgataagacaaataaaatcgttccgataatctgtaacttagttctcatcaaaactccattcatctaggctgttgaggacatgggttggagccaggggtaagtctgctacttcttctggcttggtaaatcctgtcaggactaaaagagttggaaatccattgtcaatccctgcacgaatatctgtcaggtagttatctcctaccataactgtctggctgcgttctgtgcctaaaatctccagagccttgtccatgataatggcttcaggcttaccgataaaggtcggctctactcgggtagcagctttcaaaagcgcaataagtgagcctgctcctggcaaatgacctctttcagtcggaatgttcaaatcaggattggtaccgataaaggtcgctcccttttgaatagccaaggtggcaatggtcagtttttcataggtcaactgagtatccaaaccgacaacaacataggctggattttccgtgtcttccacataacctgcctcaaaaatggcagacttgagcccgtcttctccaatgacatagactgtcttttccttgcccaagtcattcatataatctactgtcgccagactggctgtatagattgtttcaagcggtgtctcaatgttaaagttttcagccaacatagcctgcaccatctcaggacggcgggtggtattgttggtcacaaataaatagggaatctgacattcttgcaagcgatgaataaaacgttcaccagcaggaatccgctttttcccttcataaatcgtaccatccaaatcaatcaaataacctgtatatgtcatttttcctccttaatcaaatcgtgtttcccaatgctcagaccgactagcttccaagcaaagtgctaactgctcagctgtatttttcccaaggtagagcggtggtaagtcatctagactgaaaaagccactggcaactgtttccgaattgggctgaaactccccgccaaggagacgacatagaatgaagaccttggtcacgcggtgggctgacttggcaggattgttcttgtgtttgtccaaaatcgccaccacacgttgagcctccacatccagccccgcttcttcctttacttccttgactacattgtccttgacagactggtccacatcgcaccaaccgcctggtaaggaccagagcccatcgttttcctgaaccagtaggattttatcctcttggaaaatagctgcgcgggtatccagcttgggtgtctgatagcctgtttcattgcaaaacaagtctttcactacttccaaaggctgtccagatggctctaccaacatttccgccgcaatctgtctgatttcttcgaaacgttccatgtcataaacatcttttccataggccaagcctgtctgagccaaggcttgtaaacgtacggcccattccaaccacttatcctgcgacatgacgttccctccattctatgacagcttgcgcatggatatgcccatctaccacaatctcatgctgactaccaccagcttctgccaccatacgcgaactcaccaagctagttgcctctacctctttaagatacttgagttgtatttttttagggacatggcagagcagaaaatcatagcccagtgcttcatacatccattccaaatacttgccattattgacatgcccattcatatccaagtcaaaatagcgaacaggaaattcttggacagatggattttccaagagctgatacttgggagcccgaggcaatttcttgacctgctcagactgataaggagcaatcaaatcttctggcacaggcgccaccttgcgagtttcaaaatcaatcaggacaaaatagcagagaatgtccaacaaaagattgcctgctgcatcgtagatatagaacatccgatgacagaaaaacttgttgtaggcaaccgcttctgtcttaatggtaatggtttcattgtacttaggtaaacgttgaatggtcagttcataatctgtcaccacccaaatcaagccaaattcctgaaaaacatagaggtcactgcgacccagttcttccgactgccgacctgatacaccaagacagtaggaaataaagtcaggtagtttgatttcttgtttgacatccaccatatcaaaaggaatggtgaactcttcttggtatgttagtcccataatgttgatctttctagtcttaaagtatagtctttcagttcacgtcaacagctgcaggtagcttcaatagtccagtggactattgaaggttggaaatcgtacttacgatagtaagtaacattcgtagagtacggcaaagtgagttcaaatactccagtggagtgtttgaagttggaaataaggaaacgaagtttcttcgctcgtcgaagtaataaaaacaaactgaatgactatatgaaacgctctgcaactgtatcgcccagaaacaatccctttttagtcatccgaagccaacagtcttcttcttgcaagagtccttcatttttcaagtctctgaccacctgaccgtagcggtcttcaaaggagataccaaactttttctcgaatcgctcaatggacacgccagtttttttccgtagccctaaaaacatctcttcttccatctgctcggtcttgctgagaaattcttcgtgtaagcgagaatggcctttttcgcggatggacttgaggtagtgctggatgggggcacggttgcgataacgcatgccgtcgatgtagcctgaagcccctgctcccaatccgtaatactcggagttgtcccagtacatgaggttgtggtggctttcaaaaccaggcttggtgaagttggaaatctcgtagtgttcgaagccgtttttctccaactcctgaagaatgtagtcaaacatatcggactccacatcttcgttgggtagatgaagattgccgcgacgctggcggttcatgaagaccgtgtgattctccaaaatcaaactatacaagctcatgtggggaatatctagctccaaggccttggcgacattgtccaccacctgctccatggtctgaccaggcagggcataaatcaggtcaatggaaatgttgtggaagcccgcttccttgagggccgcaatggtttcataaatctgggcctgattgtggctgcgaccaatttttttcaacatacggtcatcaaatgtttgaacgccaagcgacacccgattgcacttggactttttcagaactgctatcttatccgccgtcaagtcacctggattggcctcgatagtgaattcttccagctgtgacaagtccagcaagtcctccagattggtcaggaggtagtccaactgttctgccgatagagccgacggtgttccgcctccgatgtagagggtcttgagggctggaaggtcgtaaaacttgacctcttccatgagggctaccaaatagtcatcaacaggctggttcttaataaaaaccttggaaaagtcacagtagtaacaaatctgggtacaaaatggaatgtggatataggcagatgtcggtcgttttttcataagaactattatagcacactgtctataaaaatattttttacagccatcacttccccctcaaaacaatgatataatatagtaaacttacaaaatctacaaaagggattaaatcatgaacaaagaacgattctatgatgtcatcaacgctatcttatcattcttattctgccgctggctctttatgacctttcttttttaccagttcacgaccattttcatgacagttgatttttggccgacacttgccgcaatcctgttaatgaccggattttgctttaccctatttcgacttgtctataaaccccacatttcgcgactgacactttggtttttctacgcttgctacgggcttctgctagtctatcttctctttttcaaaagcatgggcgtcagaggtgtcaactagaatctccttagcactttttcacaagacctatttctcaatcctactatattggtttttaacctcttactctttttaccacttgggttgcttttttcattttcttggaaaaaactttctctctttgtaggtgctattttactggttgaagcctgtcaattcttcttttcactgggcttctttgaccttggcgacatcttgcttaacacttctggctttgcccttggaaaccttttgggaaaatccgcaatcgctcaatcttttaaaaatagaatacagaaaaaatgaccccgcaaggtcatttttagtttatttatactcaatgaaaatcaaaagtagcctaggaaacgaagccgacgatagaactgaagttcatctaggctcttgacaacggataattttgattttcgaagagtattagcttacttaacttccaaatgccagatgtcttcgttgtactgttgaatagtacggtctgacgagaagaaacctgctttagcgatgttgacgatgactttttccaaccagctgtcgcgatcttcgtagtctgctaacatctgctctttagtcgagatataatcttccaaatcaagcagggtcatgaagtggtcattgtgcttaaggttatcctgcaaacgccagagacgctcatcgatcccaccagcatgacgaatggtatccgatgtaataaagtcaatcaatgggcgaatggcttcacgttcgtagaaggaatatggatggtaggtcccatttgcatagtgttcgataactgtttggctatcttgaccaaagatataaatattttcatcacctaccaactcatgaatttccacattggccccatcatctgtaccgatggtcaaggctccgttgagcatgaatttcatgttacctgtaccagaagcttctttggatgcaagagaaatttgttctgaaatatctgccgctggaataatataacttgcctcggttacgttatagttttcaatcataacgagttgcaagtgtggcgccacgtcaggatcatttttaatcacctgtgacaataccaaaatcaaatgaatgatgtcctgtgcggttgtgtaagcaggtgcagcctttccaccaaagaaaactgttaatgggcgagtagggatgttgcctgctttaatatccagatacttatggataacataaagaacattcatctgctgacgcttgtactcgtgcatgcgcttgatttgtacatcaaagatggattctggattaacatgaacaccttgtgtcttggcaatatggcgctgcaatttgcgtttattatgctgctttgtcttttccaaccaagatttcaattccttatcatttttgtaatccaacagcttttcgagctcacttgcatcgtgatggtagccatgtccaagtaggccgtccaggtagcttgccaaacttggattagcatgcatgagccaacgacggaaggtaatcccatttgtcttattattgaatttttcaggatatagctcatagaaagctttcaactctgaagttttcaaaatctctgtatgaagtgccgccaccccattgatggaataaccataatgaatatccatgtgtgccatgtgaacacggccatgttcatcgatgatattgacagcaggatcatccttcacttctttggcacgacgatccaattctacgatgaacggtaccaagtgcggaaccacatagttcagaaaatcaagcggccatttttccagcgcctctgacaagatggtatggttggtataagcagtcattttcttaacaatttcaactgcctcatcaaacgaaataccacggagctccaaaagacgaatcaattctggaataacaagtgatgggtgagtatcgttgatttgaacaacggcataatcaggtaggtcatgtaagtttgatcccttagcaaccgcttcgtcaatcaatagttgcgcagcgttagacaccatgaaatattgctggaagatgcggagaacttttccttcatcggtcgaatcatctggatagaggaagagggtcaagtttcggaaaatatcttccttatcaaattctattccgtcataaatgatattgtcatcaactgaaccaaggtcaaacaagcgaagtcgattcttgcgttccattttataaccaggtacatcgatgtcatacaacttagatgtcaaggtaaagttagcaaatggcacctgataagaaatcggtgactctgttaaccatgaacgtggtgtaatccactcgtttggcacagcagactgctgatggtattcaaataattgtctaaacagtccaaagtgataattcaagccgaccccatcaccgttaagacctagactagcaattgaatcaaggaagcaggcagccaagcgccccaaacctccattaccaagagacggttcaagctccatgtcttcaatagcaatcaaatccttaccagctgccaccaactggcttttaacctcatcataaagaccaaggttgattaaattattagacaagagcttaccaattaagaactctgctgaaatatagtagacctttttcttttggtcatttgtatacttagcttcactctgctgttttgcaaaagcaagcaaggcgtaatagagttcttggtctgtacaatcttcaatgcgtttggcatacatagactgaacaaaattttgtaaattaatcatgagggctctcctagatatattaatgtaatcattcagaaaggtttcgctttacctttgtaaacgttttcttaattataccctatttataaaaaaagacaagccaacttccgtacaaatagaaattagttcgtcttttaaacgattgcaggttactacaatcagaattattcttaattattctgcaatcagagtttccaaaccaactttcatcatatccgtgaaagtattttgacgctcttctgctgtggtgtcttcctctggattaaccaagctatctgaaatcgtcataatggcaagcgtttgaacgccaaacttagcacctaggtaataaagtgcagctgcttccatttctacagccttgacacctagttgacctaattctaagttgcgactaaacaattttggagaatagaaactatctgatgataaaacattgccaacatgcgttgtcatgttgagttctttggcgatatgataagccttatctaaaagatcaaaatcagcgatttgtggcaaatcgtactctggccagtcaatattgatcatacgagagttggtcgcagctgcctgagccaagaccaattcacggacatggacatcctcattcaaagaacctgctgttcccacacgaattagttttttcacaccatattcgttaatcaattcatgagcatagatagatatggatggtattcccatacctgttcccatgacagagacacgatgacccttgtaggtacctgtgtagccgaacatattgcgaacttcgttgaagcaaacggcatcttcaaggaagttttcagcgataaatttagcacgaagcggatcaccaggaagcaaaatcttatcagcgatttcgcctggttttgcggaaatatggatagacatgtaatgtacctctttgttctattttcgaatacttacaactcagccaagatagccttcaccaagcccttgaagttgcccttgatttgctcggttacttctacaacttcttcgtgattaagttcagattggaaaccagccgcaaagtttgtgatagcagaaatacccaagactttcatgcctgagtgagctgccacgataacttctggtactgttgacataccgactgcgtgggcccccatggtcttgaaggccaagatttcagcaggtgtttcataggtagggcctgtcacaccgaggtagacaccatcgtccaacttgatacccaatttttccgcaacggcatgggctttttcacggtattctttagtgtaggcattggacatatctgggaaacgtggaccaaattcttccaagttttcgccaatcaatggattttggccagtcatgttgatgtggtctgtaatggccataagggtacctggaccgtagccaataccacctgcggcattagtaacaatcactccttcacaaccaagagctttcatgacacggactgggaaagtcacgacttccatcggatttccttcgtagaaatggaaacgaccttgaagagctaagaccttacgtcctgccaaatcaccgtaaaccaacttaccagcatgaccaacaactgttgatttaccccagtttggaatatctgcatagtcgatgacaatagcattttcaacttcttgggccaattcacccaagccagaacccaaaatcaaaccgaattcaggttttaccaaacctttttcttccaagaacgtttttgtttcattgatttttgcaagtaaactcatattttctccttttataaataatccgaccagtcatattctggcattttttctttaatgatttcaagcggacgacagaggaaggctgtctgctctcgctcgataatggggcgattgagagtggcaggctctttaactaaacgctcaaagatttcttcttctgacaaggctagtcgttcttcttccttcaatcgaataactgctgaaggttgactgcccattttttccaagagagctgtcaattcagttccccttaatggtgtttccaaataattaacccacttgacttccatatcctggctggacagcaatattcttaattttttacacttgctacagttaggattgtaatagaccgttagcttctccattaaaccaattgtgacaagaagctttcgccaatcatggctgtgtccactccgaagttttccgcaacggttgctgaaatgtccgcaaaatggcctactggcaaaacaccgctacctttgaaagccttgctgtatgctaagagtggcacatattcgcgtgtgtgatctgttccagcataggatggatcattgccgtggtctgcagtaatcaagagcaggtcatcttcacgcatattgtcaataatctctggaatacgtgcatcaaactcttgcaaacaatcgcggtagccttcgatattgcgacggtgaccatacacagcatcaaagtcaactaagtttgtgaaggagaaaccttcctcgaagtctgataacttcagagtatcaatcaacacatcgacaccgtgcatgttggacttggtgtgacccatatcatttgtaatacctgaaccattgaaaatatcactgattttaccaactgagtaagttggtacacccgcatctgccagtttgttgagtactgttgcctcaaaaggtgatactgcatagtcgtgacggttggcagttcgtgagaaattgcctggctcaccaacgtatggacgggcaataatccgaccaagaagagctgggcgttcaagggtaatggagcgagcgtattcacagatacgatacaattcatccagcggaataatgtcttcgtgggctgcaatctgaaggactgggtctgcggaggtatagacaattaactccccagtttccatttggcgagggccaaagtcatcaatgacagctgtacctgaatacggcttgtttgcttcgcggatgattttacgacctgagaattcttcgatttttgtcaaaatctcttcagggaaaccatcccagaatgtatcaaatggctcagtaatattgagacccataatttcccagtgtccagtcatggtatccttaccaagcgatacttcttccaacttggtcacgtaaccagttggatggctttcagcaggaactgtcgcaagcgctgtatctcgagggatatttccaagaccaatcttggtcatattaggcacctcaagcccagctttttcagaaatgtggccgagagtgtcagattctgtatctgctacacccgcattgaaaaatttatctgagtctggtgctgcgccgattccgacagagtccataactaccaagtgaacacgtttaaatttaggcataattgtctcctttatttgatatagttagattcaaccaaaatcagcgtccaaccaagttgctagactggaaattatcatcaccacacctaaacattttaatggggtgcaatacttatacagtcaaagctctcggcatcaaacttcttaaccatcaaaactagatactgttactcgcttcactgcctgctgttcagctatcgctttttcagtacctatcatctgactgctacgaggtaaggggatagatttttgaagagtctaaacgttcgtgttttcattataccataaaaacgcctctcattgtaccaaaatgagaagcgttttcaatttatttcttttcgatgatgttcggtccttctggtgtaccaacaattaccttggaaatcaatccaataaagagaccgtgttctacaacaccgacggtccgatccaattcttccgccaatgcatatgtgtcttctattctgcgcaaatcaaggtcaatgataaagttctgcatatccgtgatatgtttttttccattacgcatacgaaaacttggacgatacccttttttctcaaatagtcggaaaagattttccgcaccgtactgcacgacttccaccggcaacttgaaggctcctagggtttgaaccatcttagactcatccacaatccagatgcagtccttgctattgactgctaccactttctccatgagaagcgctgcaccaccgcctttaatcccattgaagtcaccatcaacctcatctgctccatccaccgtcaagtccacatattcgacttcgtcgatattttttaggggaatcccaagggacgcagcgtgctcagccgtggcatgagaggtcgttacgcctgttatctgtagcccttcttctgcaacccggcggccaatctcctgcacgaaatagtatgccgtcgaaccagttcccagcccaacaatcatcccgtccgtcacaaattccgccgccttaatcccaacctgctcttttaggtttatcatctttgtctcctttgaagtaaaacgaatacatatagtatagcatggagagggagatgggacaagagtgagttagaaattcaaaaaataatgtcttaaatcctaaaaaatttttttcatttgttcaaatatatttgctactaacttagggacgtaggaaaccttatgagaagttagctgatgggacagtccaagaaattgaagtgccttatgatataccagagagctgggagtgggtgaggttgggtgctattgttactgctaaaggtggaaaaagaatacctaaagggtacaatctgcaagaagaagataatggtcatccatatcttcgagttacagatatgaaagatggtacgataaaaccaactaatataaaatttgctccagataatgtatatacaataataagaaattacactatttcgagtactgatatatatgtcacgatagctggaactattggtgatgttggaatagttccggaaaattttaataatgctctattaaccgaaaatgcccttaaactgatgctgacagaaagtatcaataaaatgtttttggctcatctcttgaagtctccattagttcaaaaacaattcaaagaagtttataatcaagttgctcagcctaaactgtccattcgtagcacaaactcaacaattatccctctcccacccctagccgaacaaaaacgaattgttgcccaaattgagcgagccttggaacaagttgaagtctatgctgaaagttacaataaactccaagagttagatagagcttttccagataaactgaaaaaatctatcctccagtatgctatgcaaggaaaattagttgcacaagatccgaacgacgaacccgtcgaagtcttacttgaaatgattcgtgctgaaaagcaaaaactctatgaagaaggcaagctcaagaagaaagatttggcggaaataatggtcgaaaaaggagatgataactctccttatgggaagattccgagaaattggactcttctttctgtcaaagatattttttcaattacgacagggttatcttataagaaaacagatttagctatcatccaaagaggtgtgcggattattcgtgggggaaatatcgaacccttagcatataaattattagataatgactactatattgagtcaaaatatattacatcagaatctgtttacttgaagcgaaatcaactagtaaccccggtctcttcatcgttagaacatatcggaaaattcgccagaattgataaaaattattcagatacagtagctggaggatttgtatttcaactaacaccatttatctcgtcagatactttatcaaactatctattactttgtctctcatcgccacttttttacaaacaactacaatcagtaaccaagctgtctggacaggctttatataatattccaaaaacaaagttgaatgatctccgtattgccttagctcctgaacaagagcaagaacgtatcagtaataaagttgggcaactttttcaaaaagtaaatctactttagttacaatatctttcatttctcgatagttagaaataggtatcaataatcctgaaatactagtactatttaacgtttttccttttatagcatcctttgaattaccagtggttgagattaggggcaaaaatcgcatcagatagtctcttatgatattttctttatctccgtacggaaatattgagattatcgcttcattatggctagcagggacctctaatgctactttaccaatagttaacttaaaactcatcaacaaggtgcctgccgaagctatctttaccttcttctgattaatagcaaaatctgatagatattcttttgttttgaagatgtgaccattgttagacatatctgaaatagatacccaaggaatatcgtctccccaataattcggctcacttcttggaggtgtttttccaatattaaataaaactagaccaccaaacttaacgtagcaccaagaactaggaagtttaaacaaagttgaattactaaaaccaatattttccttgttcttcccataaggagagttatcatctcctttttcgaccattatttccgccaaatctttcttcttgagcttgccttcttcatagagtttttgcttttcagcacgaatcatttcaagtaagacttcgacgggttcgtcgttcggatcttgtgcaactaattttccttgcatagcatactggaggatagattttttcagtttatctggaaaagctctatctaactcttggagtttattgtaactttcagcatagacttcaacttgttccaaggctcgctcgatgtgagcaacaatccgtttttgttcggcaagcgggggaagggggagaagtgtatctccaaaacctgaagcagaaatctccttaaatgtcgtacctgatgatcgtagaataatatcttttgttcgaaattgcaaaatccaatacataaaatctaaatttactagtattggcgttacggatttacaaccttgatttgtagtaaagtcatagttaacaatgtttatatgtcctattggagctcgactagaataaacaatagagttttttgaaattagttgagcagaagatttttgtacgcctaattcggtaattttttttgatgaggtggcaaataatttattgttttgctgtttacccatatctgcaggagttatccaagtgatattcccatcataataagtagattcagaagatttcggtgtgcctcccgaagtaataactcctaaatttcttaacctcacccactcccaactatctggaatttcataaggtacttcaacttttttaacagtcccatcagctaacttctcataaggtttcccatcatcactacgaaaaaattctgtttcctttttatctcgcttgacttttccttccgaaatcaacttctctttctcttccttgatacgtttcaaaagttcacttgcaggctcatcatttgggtcttgcggaacaagcttaccctccatcgctctttgcaggatacttgctttcagttgttcaggagtcattatttctcctccaaaatttctaaaatttccgccaaaacagtatcaatttttttatttaggacagctcgttcttgctgatagttttggataagttcaagtggctctaaaatttcttcctcttcctttggaaaaccgcattgatcaaaattatagtttaaactagctaactcatctggtctaaacgatttagatttgtagaaattcccttctaaaatctcttgtcgatttttccaccattcgcgaacaggattaaagtgatcgtttctcattggtttagttttagagaaatttttatagccttctggcatatccaatctgtaaaaccaagtttcttctgtttttttcgtcttatcaaaaaagagaatattcgtatgaattcctgtatatggagcaaatacgctatgtggtaagcgaataatagtgtgaagattaaactcctcaaccaatttctgctttagtcgtgtttttactccttcaccaaagaggaatccatctggtagaattacaccaacacgaccattttctttaagtcgatacataataacagccataaacaaatctgctgtttcagagctgcgtaactctgctggaaaattattttttattgtttcaagttcagaaccaccaaatggaggattcatcatgatgatatcgaacttttcatcctcagtgtaatccctcacatttttttccaacgtattcccgtggatgattttcggatcatcaatttcatgcaagaataaatttgtcaccgctaataggtgggggaaagcctttttctcaataccaaaaactgcttgattgtatttttgaacgtcttcgctagtctttcgctgttggcttaaatgatttaaggtagatgtcaagaaaccacctgtcccacatgctaaatctgccatcgtttcccctaattgaggattgagcatttcagcaataaaatctgttgctgcacgtggtgtgtaaaattcaccagaatttcctgcactttgaatatctttgagaatcttctcataaatatcattaaatgagtgacgatcttctggactgttaaaatcaacttcgtcaatcacattaatcatttgccgcagaagaactccatttttcatatagttgttagcatcttcaaaagcagattttacaattgatttgcgaattggcatgtttggagtgatttcgagttctttcaactctttgaacaatttattattcacaaactcaagtaagtcatctccagtcaagacctgctcacccttctcagcatgagcccagtttcgccacttcaactcctcgggaataattgactcgtattcttcttcctccaactcccaatctaactctcgactgtcatagatttttaaaaatagcatccaagacatttgttcaattctctgggcatcaccatttatccctgcatcgtttcgagtaatatcttgtattcgtttaacaaatgatgtaattgacattttttcctctcattaagctacagcaaatagcttttcttctaattctttaattacttctaagtaatgttttctatttccaaaataggtattaacaatcttggaaggagtaccataaacatgaaattctggtaactttaaagtttcgatactttcaagctcaccgattcccttatccatatacttatctagtaaaacctctaatacagcacgcgcttcttcgctgtatttaaatagatatccactttgtttcacatttctgattcgctcggttttagtcaaacttttctgcccgtatgccagtttcaaaagtaaatcaaaatcatcgatttcttgctccgaaatattttctgcttcacgaattgcatccagatatacaccttttttatagagttcttctaaaataacttttttcttatctgctgaatgccatgcagtaataaaatcggttaatgtcgcatatgttcctaaaatatttttacgtgtataatctgttagactctcagttactaatttcccattttcatccaagacttgaactgtcgaattgagaatatccactttcctatccgcaactcgatatttttctataggatcacctactgtaaatgatgttgaatcctgtccagttttcagattaggatctaatattttcgccggctcaccatcaaatccaggatcagcaaatagatttgtcacattcctaaaatcaataatagtgaaaaactctttccctttttcaggatataaacgtgttccacgaccaataatctgtttaaattctgtcattgattgaatatttgaatctaatacaatcaatcgacaagtttttgcattaacacctgtggttaaaagtttagaagttgtcacaatcgccggaaacttagagttaacatccataaaattatctagttgggcttttccttcaggattgtcacctgtcacctgcataacataacgatagtcctcccgtaccaaatcctgattttcgttgacaaatgcttcacgcatacgttcggcatgatcaatatcaacacaaaatacaattgttttgtcaaagcgtgcattattttgtttcatataatctgaaacaaattttgcaacctttcgtgtacgatcatcaatgataattgtcttatcaaaatccttgcgaccataatacctatcttcgataagctgtcccttagcatcaacttttccattttccggacgatagccatctacgtccacatctagattgactcgcataactcgatatggagcgagaaatccatcctctatcccttgcttcaggctataagtataaattggctcaccaaaatactccatattggaaacttctttagtttcttttggtgtcgcagtcataccaatttgcgttgccgatgaaaaatactcaatcactttacgccaattactatcttcttttgctgaacctctatgagcttcatcaatcactatcaaatcaaagaaatttttatcaaatttttgatagtgagtttcggttccatcttctcccattaattgctgataaagacctaagtatatttcaaaagaatttaatttttctggcgcattcagcaattttgatgtgattttagtcatcactttttcaaatggcttgaaatcttctgccattgtttggtcaactaaaatattcctgtctgctaaaaacaagacacgctttgctaatccggctttcctaagtcggtgaataatttgaaaagccataaaggtttttccagtacctgttgccattacaaacatgactctgttttgcccgcttgcaactgcctcaattgtacgattaattgcaatttgctgataatagcgtggtttcttaatcgaaaaagcatctgtatagtaaggagttgttattgctttcgaaacctctggtgccatttctttttcagcctttaatcgctcaaataattcatcacgggttggaaactcttctaaagagagttccctctcttgtctagtaattcggtcatgctcaacaaacccatcaccatttgaggaataaacgaaaggaacatccaaaatttcaccatattcaatcgcttgttgtaaacctgcacgaatactatgcttattatccttagcttcaacgattgcaattcgctgtccaaattgataatagagagcgtaatctgatttttttccctcttttcgacgtcctttatcacctcgaacttctattcgaccatctgtgaaatattcttcataagcaatctgttctccatttttccagccttttgacaaaatagctggtgtaataaagtttgctttaatgtcttcttcactcatctcttttttagatttgataaatacaaccataattttcctctttcagtatgaataataacttcaggataataagattatcagaacaaactatatttctattataccacacctaaataatcaaactacaatattataataaagtaattctcaaagtaaacataaatatatttacatccccatccctcatctgtgcttttttcatcattccatgatacactaatagataagacaattttagaaagaaagatatatgattaccaaagaattcgacaccattaccgctatttccacccctctcggtgagggcgctatcgggattgtccgcctatctgggacggacgcttttgccattgccagcacggttttcaagggcaaggacttggcgactgtacccagccacagcctcaactacggtcatgtcattgatcctgcaacgggtcaagtgctggacgaggttatgattggagccatgcgttctccaaagaccttcacccgcgaagatgtcatcgagattaacacccacggaggcatcgccgttaccaacgaaatcctccagctcctcattcgccaaggggctcgaatggctgagccgggtgaatttaccaagcgggcctttctcaatggtcgtgtggatttgacccaggccgaagccgtcatggatgttatccgcgctaagaccgacaaggccatgcataatgccgtccgccagcttgacggctccctctcccagctcatcaacgacacgcgccaggagattctcaacacactggctcaggtcgaggtcaacatcgactaccccgagtacgacgacgtcgaggaggcgacgacagagctggtccgtgagaagaccctccagttccaagctcttttggaaaatctcctccgcactgcccgccgtggaaaaatcctgcgtgaaggcatcgcaaccgctattatcggtcgtccaaatgtgggaaaatccagcctgctcaataacctcctccgcgaggaaaaagccatcgttacagacatcgcaggaacaacccgtgacgttatcgaagaatacgtcaacatcaagggcgtccccctcaagctgattgatacagcaggtatccgtgaaacagacgacatcgttgaaaaaattggtgtggaacggtccaaaaaagctcttgaggaggccgacctgatcctgctagtcctcaacgcatctgagcccctgaccgagcaagaccgcaatctcctagccatttccgatatggccaaccgcatcgtcctgctcaacaagaccgacctggaagagcagattgaagtagaccaactgcctgaggatgtcattcgcatttccgtcttgcaaaaccagaacatcgatcagattgaagaaaaaatcaatcaactcttctttgaaaatgctggtctggtagagcaagatgccacctacctctccaattctcgtcatatttccctcattgagcaagccgttcaaagcctacatgctgtcaatgacggactgaaagtgggcatgccagtagacttgttacaggttgacctgacacgctgttggcaaattttgggagaaataacaggtgatgctgctccagatgaactcattacccaactctttagccaattctgtcttggaaaataagaacaaaagtcatgtaagaaaacttgcatgactttatttgtatattaacacataatttcttgtctaagatgacaaatttagatatactaaacagtgaaaggcggcattcccatgaaaaaacttcttatttgtattgtccttctatcctgtcttgtctttccatttatcggctggaaactatatgcctatcagcacaatacgatcacattaacgtcggaagctgatttttacttgatttatcctggcaaggtcgagacttttcagctaaatgggcaagagcctcaactccttcatacacagaaaatgaattctcaagggtattttggctctggtgaaaattatgtcatagacaatcggtatctagtctttgccaacgatcagcaaaaattcattaacgacaatctgatatccatcgatttcaatactggcactgtcttgcgaaagccaagtcagtatagtagctatatcagtggtacagatggacaagacttttatacagtggggccctatcacatactagcgcaatttgacaggaattttgatactattcaaacccacgttttaaacgatgacttcatcccaagtgctccagtcatggtagaccaaacgtcagtctatttaactggttttgtgaaagattttacccaagaaggacccgaagaaaatgtcttgattgtatttgataagaaagatttttcaaaacaagaggtattcaagtacgacaataccattgccacaggagaagggctttgggtcaatggaaccatctatctcccaaatttagggaaaaaaacaagtgagtatacggaaattgaacagtcatccgaactcctaacctttgatacaaaaacaaaaacattttcgtcagtaactttagaacacccctcaccaagcacactacatgctctcaaagaccagaagcttctcctcatcgaacatcaaaatggtatgtttagcccgatctcatttaccatttataatacccaaacaggtcaagagagctaccatcgtctagacgagcttaatcctcgtccttattatattgaccatgtccgccaactagacggtaacagattattattgattctggctggtaaggcactcatctatgactggcaagcaaaaaaagttttaagccaaactattctatctgaggattatgttagcggggtgtgggtaaatgactgataaacaaaaacgaatctcaataaagattgtaaaagtcccaagatgactctttcttgggactttcgcatattctatcgaagttgcacagcacaatcaatgtacttataaatcctaggaaccactatctaatcgaagtaaacgccattcccaaagcagaaccaaaataatatttccacctttcttgctctaaatagcgcttaaacatctttaatttatccgattgaatcctattcaaagctagttcttccaatacccatggataaattttatacgaaagatagctaatcttactacctttttcacacaactccattgcttccaacaactggaatttcaatgctttgctcaactttaattctgaatcagataatagttcatttattttttgtataaacaacttactttttttactgtttctaaacattttcatcttcgtagggatttctgaaacaatcatgcgatggaaatgatggtgcaaacctactcagtcacccatctcttccaactgcttattatttttctttgtccccttccacttcttttgtttcttgggcagtcagtaaacctgttgacatggcacgaccagttagggttgcgctgattaaatcacggacattgagtcctagaccttctgttgtcttgtccatggtcgtcatcaggtctcccaccatttttgaggcattcccttcgccgtacatggtaatcttatcaacatttccaagtggtgctgcaatattcttggcgatttctggaagaacattgaccaccatttctgtcaccgctgcatcattaaacttagccatggcatccgccttcttgctgagtccttctgcctcggcttcgagtttcaaacggatggcttctgcttcggcacgtcctttggcctcaatacctgccgcttcttgctccgcagcatacttggcagcttctgcacgcgctttttgagcttccgcttcacgctgcgtttcgtagagttctgcttctgccttgcgttgacgttcaatcaaatctgcttctgcagcttgttggcgagcgtatttttctgcctctgcctgtttgcggatagtagctgagagctcttgttcacggaccttaacttcctctgcttttacttctgcttctttttgttgcttgacaatattggcttcagcagttgcacgctcgatttctttccgttgagcttgctcctcaatgccataggctgcgtttgcctgtgccagttggacatcggaccgacgttttagattagcttgctcaatagctagttcattctgtttcttggcgatttctaagtctgcagcaacacgcgcatcattagccgccttatcctcacgggcacggacttctgcttgttcccgctctgctttggcgcgagcatttgcggcatccttctggatggtcacaatattgtcaatacccaagtttttaatgacatcgttgtcatctgtgaaggattgaaccgtaaaggcaatgatttccagccccattttagccaagtcaggagctgcgttggattggactttttctgcaaaagcctggcggttattgaccatgtctcgcagttccatctgaccaatgatttcacgcagatttccttccaagacatcttgaatagaggcagaaatatctgcagttttccagttaaggaagttttgagctgccgcattgagcaattcatcggataccccaacctttacttttacgaccgcgtcagcttttacgttgataaaatcaagagtcggcacaaaatctgtggtctgcacatctgttgaaaactgctcaatagagatataggagcgtttttcgataaagggaatcataaaaccagaacgaccaattaaggtccgaggtttgcccaagccggtaatgacaatcgcttcgttaggcttagcagacacataaccaaatacaaacaataaaacaaatagtacaacaacaataattggtatcataattgccaatatatcaaatccaaagtccatatttatctcctttattccttatcactcaaatccacacttggcacggttgtcgccgcatcatttgttgcttggaagagctctactttttcatatccgaatagacctgcatagatggaggtcgggaaccgcttgatttttttattgtaggtagttgctaccgcattatagtctttacgggctaccagtatccgattttccgtaccttcaagctctgttatcaggtcagatacctgttggttggctgtcaattgaggataattctcagccactaccaacaatctagacactgccgaatccagctgactttgtgcctgattgtagtcgctggttcctacttgactggagccgattttagcacgcgcttctgcaatagcagtaaatatttcttcctcgtgttccatggcgcctttgacagctgcgactacattgggtatcaagtcatagcgacgttgcaactgtgtgtctacattggcttgcgcattttcaacctcagcataactgtcaactaagccattgtattgcccaactgctcccattcctaaaaacagcagagctaggactggaatgagaataaccaaccatctctttttcataagatttcctttctaactacgattaaacattcgtaaaaaagcaaacaactatcagaagccttatacgatgccttaccatccagaagaggctccgccaccgccgcctcctgaccaactacctccgccaaaactagacgatgaggaattagacgagtgatgattgtgatagtgatgatgatcatcaaccaacatccagagtagattgcctggacctccaccaccacgactagatttgtcaatgataccaaataggatagcgatcagaataactatgagaaacagccagaagccgtcatccttctcacttgtaccttcttctatagcagctaactgatttttaccaatgcttgtaccataaaatctatccccaatggagttgacgatataggaaattcctctactgtagtcttcctgtcgaaagaattcccttgcattctctaaaatatccttggcttccacatctgtcaacaccgttgcagcattgtctgaggtttctatccgaaatgctctgtcagctatggcaaccactaaaagaactccgttgtccgttcttgcaaaaccgacctgccagtgacgaaaggtttcattagccaaactttcaatatcactggacagactttctgttacataaacaccaacctgtaaagcttgctcggtgcttgcccaacttcgattgagttgatcaatttctgcaatggtctcactcgagagtaactgcgtctcatccactaccgttgtacctgtggggcggtctgggatctgatttgctctagctagtgtgggtgcaaatagcaagcaaaccgttagaatagcgaaacagccgatgataatttttttccattttctcatcagaacacctccttcgatgaacaaagataagaaaaatttattaggtatatatatacaattatatcatattatcattttcccaacaatatatttatgttgtttttcagtatcggtagagtctgttcaacaaaccaaggatgtttagcttgccagatattgtttctaggtgatggatggggcaaaggaaaataggtgggtaggtaatcatctgcatgtttcactctctccgtcaggttcctttgggatttttccaaataataagtttgagcataattgcctaccaatatggtcagctcaatctgggggagttgcttcataatgagtgggtgccatttgggcgcaaaatccttgcgaggcggcaaatccccagacttcccttttcctggataatagaaatccataggaagaatggcaaaatgacccgattcataaaaagtctgtcgatccacgcccaaccattgacgaaggttgctaccactggcgtcgtcaaataaacgccctttttcctgggttttcaagccaggtgcctgtccaataatgagaatttttgcggtcgaaggggcttggaaaaggggagctattcccttgttcgtaaaatctcggttagcaacatcctcaatgatggcttgacgaatatcagcaagttccatgatgtcctactttcttgactatggtcacatcttcttctaaggctcggaaaccgcattttttgtagaaagaataggctaaaaggttgcgttcggtttgcagaagaatatgaacaatctttctatcagctaactgcttctcaatatcagctaataaactagcaccatgtccttgcccttggtaatcacgggaaatacagaactcttcaattcgatactctgttccctcataccaatagcgaatgtaaccaagtgacagccctatcaatttttcttggtcaaacaagccaaaacagagtgctcttgagtgtcccagtaaatcgcctatgtagcaatctaattgttcctcatctgaccaatcatcattccaaggttcttggctgaaaacagataaaaataattctttaaccatttccatgtctgaaaaataaagttctttcagttccatatttcctcctaaaaaagacgggcgtacccgtcttcatgtattacttaatgagttcgtagatagcttctgcataaatggcagcggcgcggtagagttgctcaacttcgataaattcgttggcttggtgcatggtgttgacatcgcctgggaacatagctccgtaggcaaccccgcgtttgagcaagcgtccgaatgtaccacctccgataacttgttcgtgacctttcaagcctgtgtgtttttcataaacagacaagagggttgcgaccattgggtcatcgattgggcaataatgtggagtatggccatgctcagacaggctaacagcttccacgcccagtttttccaaaccagccttgatggtttcagggttggtattttttggataacggaagttgagggcaatggtattgtctgatgaagtttcgtcaaatttgaaaacaccagcgttcatagaaagagctcccatttgctcatcgtagatggctacgccgagttttttagcgtcatggtcttccagaaggacttgacctgccaaatccaaataggctttggctgcttcgtcaaaggcgaattggctgaggaattttgccaagtaggttgctccgttgaccccttcttctggggttgaaccgtgggctgattttccgatgacggtgacttgaacttgaccgttttcaagggtttccgcatcagcttttatgccataggctgctgtgaaatctactaacttgctgtccagatctgctaggtcgccagagataatagctgtcgcagattcaggcaccatgttctcacgcaggccgcctgtgaaggaatgcagtttagcagctccgctattttcccccgcaaaatgaagataagctgtgatattgcccttttctccgttgataatcgggaactcagcgtctggagagaatccgaaatctggcaggggaaggccgacgtgctcgaagtagtaatccatgtccgcccagcctgactcttcgtcggtaccgacgatgaagcggacttttttagaggtcgaaaggcccaactccttgatgattttcaagccgtagtagcaagccatggtcggtcccttgtcgtcagaagatccgcgggcaaagagcttgccgtcaatgatttgcggctcgtatggatcagtgttccaaccgcttcctgctggcaccacgtccaagtgaccgaagataccgaggacttcgtcaccctcgccaaattcaaagtgacctgcgtagttgtcaacgttcttggttggataaccatcacgctgagcaatttctagaaacttatccaaggcacgcactggtccaggtccaaatgggtgttgggcatctgcctggctatcgtcacgctcagaattgatgcggaggaggtcaaagaggtccgctagaaactcatctttgcgtttgtcaaactctgctctaaaatttactgtcatatgttctccttttcagtatcaaagtaagtctattttatcacaaaatgaaagagatttcacaagtaaagcgaagaaaaaaagttggtctcccaacttctttctattttttccaagcagatcgttctgctacaactgtaaacaaaacatcagttgatgagttgagggctgtttcacaagagtcctgaatcactccgaccacaaatccgactccaactacttgcatggctaactcatttggaataccaaaaagactacatgctactgggatgaggagaagcgaaccacctgctaccccagatgctcctgctgctgatagtgatgcaacaacggataaaagaagagctgagctgaaatcaacactaatgccaagtgtatgaacagctgccattgttaaaatattaatcgtaatagccgcgccagccatattaattgtggcaccgagcggaatggatactgagtatgtatctggatccactcctaaacgtttgcagagctgcatattgacagggatattagctgctgaacttcttgtaaaaaatgccgtaaccccactaactcgaagacattcaaataccagcgggtacggatttttcttcattacaagaaaagcaatcaagggattgacaacaagcgcgacaaaaatcatgcttccaaccaagagtaagagcagtaaaccatagtcttttaaagctgtcagaccattatttgcaatggtatcgaaaaccaagcccatgataccaaatggtgccagaccaataatccatcctacaactttagaaatcacttccgccgtagattgcaataaatcttttgttgtcttgcttgcatgacgaaaggccaagccaaacactgccgcccatgtcaaaacaccaatataattagccgttgcaagagcattgattggattgtcaacgaccttcaacaagaggtcttggaatacttcagcaatcccttgtggaggagtaatgtccgtagtcgttgtagtagaaagaaccagtttaatagggaataaatagcttgctcctacagcaatgaaggccgccgcaaaagtgccaaatagatacaagcaaataactgtcctcatattcgatttttgaccagcaggagcttgtgatagagcatgtgcaactagtgtcagaaccaaaagaggggctatagctttcaatgctcctacaaatagactaccaaagagagcaatgaccgttattttgggagcaattaagcctagtaacactcccaaaacaacaccaattccgatttttcggattaaattcatttttttccatacagatattattttattcactcatttacctccaaacaaacatttttcaatcatagcagaaaaatccagtcaggtcaatagccttggcttctaaaatctattttctgcatgatgcaatctatgtgtggcgcccatttttttacgaataaatatgcatctgtaatcaaaataaaatactttataagctttatctacttactgcccagacctcaacgatttacgcaatcattttgttacctaaacagctaactccactacttacttttatttcaaatgatagctaggtaacactgacctgtaatttttctttatgtgcgaaaaatgtgttaggattgcaatgaaaagccctgccttatcagtaaagcaggactttgatggctcaagaatatcgctagtaaatatcaatatttttgataccattcttatcaaataattgtgttttcatctccgtagtcaacggagtaataacgatttttgaattagaatcaatattggatacgacaccgataatgcgaccgtctacaacgacaggtgacccggattgccccttaacacctgtgatattggtttgaagcaaaccgtcataacggacttccgtaatggttccatattcgtattcccaacgtccgtagagattaatgctgttgctgaccattagaaattgtcggccaactaggtcataggtgttacggtaaattcctagccgagcatttgccgtattggctgtctgtgtttttctgctaggggtggtgattttcacaagggctacgtctcgactagcatcccatgttccaccatatcatggcatctgaatgaagggattgaagggattggttctcttaatttctgacagttcatagtatggtgaagcatcgccccaaacagcatttccagaccaagtttggctggtcacacgtccagtcccatcatctgccactacgtgaactgcggttaataaagtattcggagctattagaatagctgaacttttttggtttgaccggaaccaacatttacttccaaataatgagataaattatatggataactattgcgtagagctggatctgaaacgtgagtcgtctgtgcttcaacctctactattgtaggaggagctaccgatagaccgacactaagaagggctacgccaagcagtaatttcgttttcatttgaaaacctcttgttttttctttcattatatcaatcctaattataaagtgcaagcgtttccaagtgttttttgttcaacaatttaggctcttctcatccattgacaatagctcaaaaataggaccagtgcttatctaactagccctgttaaaatactttctgtcagaagtatttgcctaccactttatcgataaattcgctaggtaatctgaggcaaattgagtcaagcgattgcgactgtctttggattcataaaaatcaatcatggcaaaaccagctcgtaattgcccagcaatctgttcttctaaggtgtggctaaattcatagccatattctggatcaatcgtaatttgtcctgcttcttctaattgtcgtgcgttgaaaggcaggctgtactttggaaccaaggttttgtctggatgctcccaaacatcatcagcatcaaagacataaatccaagggttcatataaccgaccatgagcagaccaccttttttcaaaacccgataagactcctgccacatattggccaaatcttcgatataaatatttgaaaccggacaaaagatgatgtcaaaactctcgtcttcaaaaggaaaggcttgtgtcatatctgcctggaccgtttgcaaatccagattttctcgctcagcaactagcctatccttgtccaactgttccttggagaagtccaaaatagttgtctcatagctatgagccgcagaaattggtccctgttgaccaccaccacaggccaaacccagcaatttcttacctttggctttttcaaaccagtcaagcggtactgtctttccaaccgtcaaagaaacggataagggcttatctttggcaacaagaaattcctcatgactgagcggaactgtataggcatttccctgtctagctgaaacccgattccaacgttcttgattgtagtttacataatctgtcatttttctttcctcgcttgaggcctagccaatatgacctcgttctgttcttttcatttttcacctcctttactatgctaattctattatggcataaagaaagagaaaaagctacctatcgatagcttttagtctacgtcaagtcgttaaaatcccagacatcgtccacccagccttcatagaaatcaggctcgtggcagaccatgagaattgagcccttataggcttgaagggcacgtttgagttcatccttggcatccacatccaagtggttagtcggctcgtcgagaaccaggacattgttttcacggttcataagcaaacagaagcgaactttggcctgctcaccacctgaaagaacttgaatttggctttcgatatgcttggaagtcagaccacaacgagccaaggctgcccgcacttctgcttgattgagggctggaaaggcatcccaaacgacttccagtggggtctgacgattgccgccagctacttcttgttcaaaataaccgagttccagatactccccacgctccacagagccaccgagcggtggaataatccccagcaaacttttaagaagagtagatttaccgataccgttggcaccgacaatggcaatcttctggttgcgttcaaaggtcagattgagcggcttacgggtcaggacacggtcgtaaccaatctccaagtcagtcgtctggaagataaagcggcttggcgtccgagccattttgaaatcaaatgatggctttggtttctctgcttgaagttcaataatctccatcttgtccaatttcttctgacgggacatggccatgtttcgtgtcgcaactcgggccttattacggttaacgaagtcctgcaagtctgcgatttccttctgctggcgctcataggccgcctccaactgagcccgcttcatagcatgtacttcttggaattggtagtaatcccctgtgtaacgggttaagagttgattttccacatggtagacaatgtttatcacatcattcaggaaaggaatgtcatgcgaaatcaagacaaaggcattttcatagttctgcaagtagcgtttgagccagtcaatatgctctgcatccaagtagttggtcggctcatccagaagcaagatgtcaggcttttccaagagcaattttgcaagaagaactttagtccgttgtccccctgataactccgtaacatccttgtccatgccataatccatgacaccaagcgcacgcgccacttcgtcaatcttggcatcaagcgtatagaaatcacggctttccagacggtcttgcagctcaccaacctcttccatgagggcatccatatcggcaccctcttctgccatagacatgtaaatgtcattgatacgagcttctgtcttgaagagttcatcgaatgctgtccgcaagacatcacggactgattgacccttttctagtttagcatgctggtctaaataacctgccgttacataacgtgaccattcaaccttaccttcatctggctgcaattgacctgtcacgatggacatgaaggtcgatttcccttcaccatttgcaccgacaagtccgatatgttcccctttcaagagacggaaggagacattttcaaaaattgcgcggtcaccaaacccatgacttaaattctttacttctaaaatactcataatttcctcacaacatcaaagaactggagtaaccaaactccagtttttacttttattctcgcagtattgagcggaacttcttcgcctatcagctgtgaaattcctactcaaccttgcgggggttagacaacaaaatcaaactctacgagttactgatttctgtctaactcccaatttccgcacgaaccacatcggcaatggtgtccacgtagtaatcgacttcagcatccgttggcgcttctgccatgacacgcaagaggggctcagtaccacttgggcgaaccaagatacgaccgttgccagccatttctgcttccattttttcaatgatagctgcaatagcaggcacttccattgccttgtccttcatgctattttccacacgaatattgaccaatttttgtgggtaaatggtcacttctgctgccaattctgacaacttcttaccagtttctttcatgattttggtcaattgcacagcggtcaactggccgtcgcctgtggtgttataatccatcagaatcacatgtcctgactgctcaccaccgacattgtagccttccttgcgcatttcttcaaccacataacggtcaccaactgcggtcacagctttttcaatcccttcacggtccaaagccttatggaaaccaaggttagacataactgtggtcacaattgtatttttggccaatagacctcgatcagcaaggtatttaccaacgatgtacatgatgcggtcgccatctaccaaaacaccattttcatcgacggcaatcaagcggtcactgtcaccatcaaaggcaagtccaatttgactacctgtttctttgaccagttcttgcaatttttcaggatgagttgaaccaacaccctcattgatattcaaaccgtctggcttttcagccattactgtcaaatctgctcccaaatctacaaaaatttgacgtgcagatgttgcagcagcaccattagctgtatcaagtgcaactttcataccgtccaaatctgtaccagttgataccaagaattgctggtacttacgtagaccttctggatattctaccacatctcctaaaccttgagcagatgggcgtggcaatgtgtcttcctcagcgtcaagaagagcctcaatttccgcttccaatgcatcatccaatttgaaaccatcaccagcaaagaatttgataccgttatcttgcgctgggttatgacttgcagaaatcatgacacctgcacttgctttttcagttttgactaggtgggcaacacccggtgtcgccaaaactcccaatttatacacatgaatccctactgatagaagtcctgcaatcaaggcagcctctaacatttgacctgagatacgtgtgtcacgcgccacaaagacacgaggaacatctgtctcatgctggctaaggacataacctccaaaacgacccaatttgaatgctaattctggcgttaattctacgtttgcttctccacggactccgtccgtaccaaaatatttacccattttcataacctcttattttgtttttgtaagtataatttgcatatttgcttccgtctgagacagtacaactggcaagacattgccgtcgctatctacagcctgtaatttagctgtaccactataattctcagacagattgctcacatccatcgcaacagcttcgacccgatcaatcttagccattgtttcttcatccgttgtcactttaacggtatctacgttgactgaaaccttagacagactgtaaccttctgccaattgattactatagactcgacctgctactgggaatgccttgctaacttttttaccaatcttgacggtaatcgcatcaggtgctagtgtcgcactcactccagccggcaaattggtcaattgtagcttgacagtctgtgtcccatcactcaactctctcaaatccgcagtcacttgaaaagtccgagttgactcatctgattctctctgtaggagaacacgattagagccccttaattcaactgccaccgtcgaagaaaatccggaaataaaatacttgtttgtatcatattcaatctcaatcggtacattgctcagtgtgtgaacataggtttctgactccgtgttctgtgcagctgattctgaatttttatagttggtggttgttgcatagaaaaagagcaacaatgctagaaaaatagataaggctaagtgacctacagctttaaacttatcattcatgtttgccacctcctaatcgcttccagatggacttcttctctacattttcagaaataaaagtcgctcgcaactctgcttcaaactcatccaaagtcaaatcatgtttaaatatcccgtttcgtgcaatagagatactgccagtttcttcagaaacaataaatacaaacgcatcagatacctccgataagccaatggctgcacgatgtcgtgttccaaattcctttgaaattcctgcgctctctgacaggggtaaataagcacaagcaacagctaccttgtcttccttgacaattacagccccatcatgtagcggtgtattcgggatgaaaatatttattaacaattcctgagatatatccgcattgagtggaatccccgttgctctatattcttgcaatgtttgggcttgttctactgccacaagtgcaccaattttacgcggagacatataagcaaccgatttgagaaaagcaacaattaacttttcttctgcactcactgtatttgtcccaaaaatctgagttgttctaccgagtttttcaagcatagcgcgcaactctggtgcaaaaataactactgctgcaataaccccatacgtgattacttgattaatcagccaagcaatcgtctgcagaccgaataaactagctataatctgaacaataatgaagagaaaaacccctcgaatcaatgtcataattttagtacctgcaatagacttactaaaattataaatcaaataaacaactatactaatatcaattaggtgcaacagtgcggtccaaggactggctatcaaactcgaccaataccctgtatccagtaactggtttaggtttaacatatcattctcatactttctaactcatacatagtaatgtactcattataccatattttttccccttttctttagaaaatagtgaccttcctgttaaaaatattacagatttactgcaggaatatatcatgttccaacatactccattctagaaaatccccaacctttatgataaaatagtcccatgaaaataaatacagctttgggtattctagcaggaaaaagttcccagttcattttgaaaaaactaggacgtggtactaccctacctggaaaaattgccctcaaattcgataaacatattttagatagtttggctaaggattatgaagtcgttgttgtgacaggtactaacggaaagactctgaccaccgccctgacagttggtatcctccaagaagcctttggcgaaatcacgaccaataccagcggtgccaatatgatcacaggaattacggcaacctttttgtctgccaagaaaaataaaaacggcaagaagattgccgtcttggagattgacgaagcaagtcttgcccgtgtaaccgactttataaagcctagtctgattgtctttaccaatatcttccgtgaccagatggaccgctacggtgagatttataccacctaccagatgattttggacggggctgcaaaagctccgcaggcaactattttggccaatggtgatagtccacttttcaactcaacgaacgttatcaatccagtaaaatactacggttttgcgacggaagagcatgagccacgtctggcccattacaataccgaaggcgttctctgtcctcattgccaccagattatccagtacaagctcaatacctacgccaacttgggtagctacatctgtaccaactgtggctttagccgacctgaactggactacaagttgaccaaactaaaagaaatcaccaatacttcttctacctttgtcattgacggtcaggattataagattaacatcggaggcctctacaacatctacaatgccctagcagctgtcagcgtagcagaatttttcggcgtatctcctgaaaaaatcaaggcaggatttgacaaatcaaaggcagtcttcggtcgccaagaaacatttaagttgggtgataaagattgtacattggtcttgattaaaaaccctgtcggtgcaacccaggctattgaaatgatgaaactggctccatacgattttagcctgtccgtccttctcaatgccaactacgctgacggaattgataccagctggatttgggatgctgactttgaacaaatcacccaaatggacattccacaagtctttgcaggcggtgttcgttcgtctgaaattgcccgtcgcctccgtgtgactggctatcctgagaaccagattactgaaacaccaaaactagaagacatcatgaccttgattgagcaatcgagtagtcagcatgcttatattttagctacttatacagctatgctcgaattccgtgacctgctggctcaacgccaagccgttggaaaggagatgaaataatggtctatacgtcattaaaaagtcctgaaaaagactacacttacgatctccacatcgcccacctctacggtgatttgatgaacacctacggtgacaatggcaatatcctcatgcttaagtatgtggctgaaaagctgggggctcgtgtccaggtggacatcgtttccctgacagatgaatttgacaaaaatttctacgacatcgcctttttcggcggtggacaggactatgaacaatccattcttgctaaggatttaccgacaaaaaaagacagcctagcagactttatcgaaaacgatggcgtcatgctagctatctgcggtggcttccagttgctcggtcaatattatattgaagctggcggtcgcaagattgacggtctaggaatcatgggccactacaccctcaaccagaccaataaccgctacatcggtgacatcaaaattcacaatgatgagttcaacgaaacctactacggttttgaaaaccaccaagggcgtactttcctagctgacaaccaaaaaccgctgggcaaggttgtctacggcaatggcaataacaaggaagacggcggcgaaggtctgcactacaaaaacaccttcggtagctacttccacggaccaatcttatcccgcaatgccaacctggcctaccgcctggtcactactgccctccgcaaaaaatacggacaagacatccaacttgccagctacgccgacatcctcagcaaagaagtcgctgaagaatacggcgatgtaaaaagcaaggcagaatttgatactcaatgaaaatcagaatcagactaggcgacgcagatgcagatagaactgaagttcatcaaatcaagtcaacaacgtctgactttgattttcgaagagtatgagaaataaagcaaaactgcttctgatatccagaggcggttttattttatatacttccaatcaaaagtaagccctccaccgttatctccgtcaattgactcaaatccagcttggactggtccacttggaaaaagaggggtgtcatgtctgccaaaatacgagcctgctctataccaatcggcagggtccggctgaccacctcttgctccacctgtcccatgtaagacttgaaatggtccacgatatcttggttgtcataggactccttgcggagttggtctttggctaaatggcggagctccttgaggtgattggggcctgggactagtttgagaatagccccaccagctttcagcactctggcaaattcctgataattggctggggagaagatgtccaagatcccgtcgatggtcttgtcttgaatgggcaacttggtcaagtcaccgacaaaccatttgaccgacttggtcctgtctgttctggctgctaggagaatagaatccttagaaatatcaaaagcaagaatgtccaagtccattttctcggctaatttacgggaataaaagccctctccacagccgatgtccaagacagaccgcaatcccagctctgctattttttcctccaaagcctcgtagagatgatcgtaatagcccgcctctaaaaaggcctgacggttttcaaagctagacttgtggtagttggcggactgcttgacctggggtgccaggttgacgtagccctgcttggcaatgtcgaaggtgtggcggttggggcagcgaaggctgttgaggtcaagaccaagagcctgcccacaatgtggacaggcgaaaaattggtcgctattggcaaaacgttggtgtttggtcatcttatttgtgttcttttctaaagcggtgcagggctagtcctgataggagcgtggcaagggctcctgtaaagaccagcaagtagccgactggaatgagataaaaattttcatgcagaatgccctcggcatcaatatactcgaccgagtttgccttgatgacaaagcagacgaagccgagaagcatgagaaaactaccaataatggtaatggtcaggtgcatctgggtacggcggccttcacgaccgtcttttacaagtttttctgtcatgttgttcatatcagttcctcctaagataagttgatctaaggagatcgaaaagacagaggacatgagaatcaagagctccaaatcaggtagattcttgtcattttcccagttggaaacagcctgcctggtcacattgagtttgagggcaaactgttcctgagtcaaacctttcttttttcgtaagtctttgatttgctgtccaaagttcatttctttctcctttctgggagcgggacagaactcgaaaaatgaaaaaaagttcgtcaacaatttttcgttttaagttgttgagctgaaacagtctatccccagactgtttcactcccacccccgcacagcttaaactgtctgggggacagtttaaggttgggaataaagcgaacaaagttcgcaacattcgttaggccagatttgaagtgtgcaacacgaacaaatctgccaatcaaccactgcgctgagatgttgacaccaccttcgagaagtgatgctaatctctatacttatcttagcttgtcggtcgatgttttccaagaaagactggcttgctctggacttttttagcgaaaagtggtcgttctaactccgcaagactggcttgcaagcttgttctatcaagggtttgagcctcttgtcaacttgctgtcaacctagcccatctgctcagataattcttcccattcttccatgagactttcttgttggctggtcagttggtcgatttctttctggtaatcggtcaactggccgatgtcgttggtttctagcatggcttggttgagctcgttcaggcggttttcgatgctatcgatttctgcctcgatttgctcgatgcggcgggctagtttgcgttgctctttttggttttccttttgggcttggtagtccatggctccagctgattggctggtactttctagctggtcaggctgggcttctgcttccagctctgcttttttctccaaataataatcatagtcgcccaaatagagcgtggagccagtttccgagatttccagcaccttggtggcgacgcggttgatgaaatagcggtcgtggctgacaaaaagcagggtgccgtcaaagtcgatgagggcattttccaagacctccttgctgtcgatatccaagtggttggtcggctcatcaaggatgaggaagttgttgttttccatggacagcttggcgaggagcagtcgggctttttccccacccgatagcatggaaacggactttttgacatcatctcctgagaaaaggaaagctccaaggcgattgcggatttccacttcaggtgtagtcggaaaggcggaccagagctcctctaagaccgtattggaaggtgtcagggccgactgggtctggtcatagtagcccacttccacattggcaccgagccaggcttcccctttgataaatggcagagctccgacgatggatttgagcagggttgtttttccgattccattcggaccgacaatggcaatggcatcgagtttccgttggtcaatagaaatgggctgggaaagaatgtttccatcgtaacccaccgcagcattttccactgtcaagacgatattgccagaagtcttgtccgactggaaggtcatattggcagacttctgaccagttgtcggcttgtccaatcgatccatcttttccaactgcttgcgtctagcctgagcgcgcttggtggtcgaagcacggacaatatttttctggacaaagtcttctagtttggcaatttccttctgctgcttttcatagttttgcaattctgtttgtaacttctgctctttgagctcaacaaactgagaataattgcccacatagcgatccaaggaatgcttggtcaaatccagtgtcagtgtcgccaccttgtccaagaaatagcggtcatggctgacaataatcaaagctcccttgtaatgcactaggtagttttccagccaagcaatcgtgtcgatgtctaggtggttggtcggctcgtccaggaccaataactctgggctttcaagaagcatttttgccagagcaagtcgagtattctgaccacctgagagttcggagatcttcatgtcccacatggtctggtcaaacttgaaaccattcaaaatagcacggatgtctgcctcatagctaaaaccacctgccagacgaaattcctccgacagactatcataggtcttcatgagctggtcgagttcattaccagaaagactgcccatttgctcttccatagatcgcaggcgtttctccgtcatccgcagatcgtcaaagacatggagcatttcatcgtaaatggtattttccgactcaaaacagctgtcctgtgccaggtaagaaagggacaaatctcgcttggtagaaatctcgccgctagtcgctgcttcttctccgacaaggattttaagcaaggtggacttacctgccccattttttccgacaagagcaatccgatcccgctcatccacttgaatgttgatattgttaaataaaacttcgcccgcaaatgagcgttcaatcttgtttccacttaaaataatcataaaaatattgtaccataatttagggtaacagtgcggaatcctttttctgatttcagcaaaaaacagcgactttaccgtcactgtccttctcaaaaaatatttagaccaaaccgctaagcaattccttattctgccagagtagataaagaccaccgccgataataatcagcataatgacaaacttaatcaagcccttaacaaagcggatgaccaacatcaatatcatagatacaatcagccatccccaagcagaagaattgagtaaggtttgcatactctctagacttgcacctgtccaggccttaattggttcagggattttatcaaaccagttgctatctataccgatttgttccataatcgaatgactggtagactgcatccatgcaaaaattccagcattatagagaaagagcagagcttgctcaggataacgttttattgtgtttgtaattgttcgaagcatattttcccttctattctgaatacaaggcaaggaccgcatcaatatctgcctgctggataccatgattagaacctgccgattccataacagaggtctgactatcttcatgatctaggccaatagcatggcccaattcatgctcagctgtatggataattctatccatatcataaccatattggtcgtttaataaataaaaactattcagacacaccgttaccgagctataataattcgtcaataaattagtcgttgaattggcctcacctgctgcctgggtatttccatcattcatctcagtagcaataatatcagcctgatttggatcacttgtcatcacaaaagtaaatgcccctgtcgcattccaatttgcaatggctgtttcataggcagctacaaatgttggattctgagtttcaatgtaaacagtcgcagtattgctttcccatcgaccatgatcggctgtattgaccgtatcagtcgtcacttcagactgtcctttaaccatcagttgcacttcttgaggtagagtttgtaacatctgaggcgctgcttcctgttgaaaatagaataatagacctagaccacaagccaataacaccattgataaccaaatcagaccccaaaatgtccgccaaatccaccgtagaatatttccaataagtttcatagactatacctctttctagaaataggttttagtatagccataatttctgaaacttttcttaaaaactaggacaatctttcttccaatttgaaatcaattggcaaccaagccaatactttctcaatctgctgattccagtagtaccactcatgtttaccaggtccgaaacttgcctctatatcaaatcccagctctttcaactcctcaactgccttttgatgcccttcaaagagaaaatcttcctcaccacaccaggcataaaatttggtctttttatcggattgtttagcaatttctaacaaattatttggattctgtttatcagaaatatcaccaaatactccttgccaatacgaaagacttcccaattctgctgccgctggattatcaaaatcaaaatacaatgcgcctgaaagcgaagctgcgtgtgaaaagcgattggtcatcatggcaatcttgaaagtcccatatcccccccatagacaaaccagcaatgaaattcttctcccgcttgtcagacatatttgggaaaaaccgcttgaggatttgaggcaactcaatcgctatggcatcataataattcataccataggtggtattggtgtaccaagccttatccgtattaaccataacaacaatcaaattagtataacgaaccaagcgttcaattgtagaccgattgagccaggaatcctggtttcctcccataccgtgcaaaagatataggacaggaatgtcgttgtcatcgggattttccacacgatttcgatctggatataaaaccgtaacctgtctagacatatctagagcttctgagtggtattcaattttcattattgccataaatcttctccttatggtaaagagcctgagtttccctcggctcttcttatgtatataaatcagcttacttgacttccataatcaccggcaaaatagctgggcgacgtttggtttggtcaaagaggaattttgctaaatcatcgcgaacagcactcttaagctctgcccagtcaaagctatcctttgtaaagtaattttccaccgttgtattcaccaattctgatgcctcacgcaagatgtccttgctctttttcacgtagacaaaaccacgagtattgaccttggctttagaaatgatttttttctcacggcggttgacagtgatagccacgataaagataccgtcttctgagaggatcttacggtcacgaaggacgatatttccaacatcgcccatggcatttccgtcaatcatgacatcaccagccggaaccgctccgctatggacaaaatccccctcttcaaaagccatgacatccccacgcttaacgatgataatgttttctggatacataccgatttcaagcgcagccttagcgtgagcatccaattgacgatactccccttgaactgggaaaagatatttaggcttcatgatgttgagcatgagctgcaaatcacgcgcattcccatgcccagagacgcgaagattctttgtgatagattttacggtaccaccagccttgtaaatcaagttctccacacgagcaacaaccgcttcttttgaaatacttggagtggtaacaatataaactagatcaccttctttgatttcaacatagcgatgtctaccgatagacattttacgcaatccatttaacggctcgcccatacgaccagtttctaaaataatcaattcatggtcttcatacttgttcatatcctttggttttaccaacaagcgttcgctgaccaaacgaagttttttcaattgaatcgctgttcggacaatgttttccacatcatgtcctgtcaatacgacacgacgaccagttgcttctgccgcgtcaaaaatctgttgaatacgtacaatattgctggcaactgctgccacaataacacgcccgtcacagtcagcaatcgtattgagaatttcctccccagcctcatgcatgctcgctacttgaacattgctatctgcattagctgagtctgacaagagggccaacacaccttcgttaccgatttcagccaatcgcccaaaatccgtacgataaaacttatctgccgcctggtcaaacttaaagtcacctgtgtagacaatatttccttcatccgtcttaacgacaattcctaaactctctggaatagagtgggtcgtctgaaagaaagataccactgaatccccgaaatcaatttccgtttcagcattgataacatggaaatcattaaatttcttagtagcattattccccttgacaagtagcttagccaattcgatagtcaagtgcgaaccaaatactggcactttcactttctccaagagataaggaagcgctccgatagcatctgcatgcccgtgagataaaaagacccctgctacacgatgcttattttcttccaaataatcgaaatttgggacgactacatccacacctaactgttcattctcaggatactttgcccctgcatccaaaacaaaaatatgttcattcacttcggcaatgtacaggttttttccattttcccgcacacccccaagagccataattttaattgtactcatctttactccttttggacatcccacaggtgtccattttatttttcttaccaacggtccttgggagctccaagtcgaattacagtctgctatttatcgtcatttagtttttcttttattacttcgacgtaagaggaaactccgtttccttatttctaacttcaaacactccactggactgtttgaactcgccttgcctgattgaaacagtctgggggactgtttcaagtcaatgcctagaaacaagaaaacattgagtcatgcctgcagctcgttgcctagtactaaaagtaaactaaaagactatattttagctatcgcttctattatacattttttcaagaaaatttacaaaaaactccgctgaaaatcaacgaagttctacatatacattagtaaccatgtcccttatgttcccacttaccaccaacattccgcactaaaatccatttccaatccgtatgagtactattaggctctaaggtgggctctgccccctcagctgctaccttaaaagacgaagttaggataatagcttcctctgcaccatagtgctccgcccactcatcaaattccttttcattatcaccactgtaaccgatagtcagcaatttacaactgttaaaatggtgatcaaagtaatcttgaactacaagaatagccgcctcaatctctttttccgtatacaattctgattgttccatcggttcaatctctgcctgataagctgctcctgtccgacatcctaccaaaaaaaggcaacacaacagactacaaatagctaaacattttctcatctttgttacccccagtcaacaatcgttgctgaaaagccaatctcttcgacaaaacgtaatacatcctccgttttgacaaaaattgttttcgtattaacattggggtggaaggttagaatgggttcggataggatttctttatcaaaaaagacttgaatatccttatcaacattatgtaacaagccaaaaacagataccgcacccgcaggcaagtgcattttttccatcaagctatcactcgaggccatccgaatgcggttggctcccaccaaatcacgaaattggtccatatccagctgcttctggtcatccatgatcagtaaataaaatgcagtctttttcttattagtcagaaacatggacttggtccgtactccttctaccccttcaatgtaacggtctgcttcctcagttgtcagagctggtggatgctctacaatggtgtagtccattcctaagtcagctaagctttcaaaaaccaatttatccatgacagcacctcttgatatatttagtatattatactgctttttaactaaaaattcaaaggataataaaagcctggattactccagactttagacctgtattcacaagtgatctgtttgatataagattcagttttagccaaaaccaaacttagttggaagttgcgaactatccacacaggttcttaatcaaacaacttataataatcttccagtttcatcttggatttttcttcagccgtttggtcctgaataatctgaccatttttcatgacaatcaagcgattaccgtgacgcagagcatcttccatctggtgagtgaccatgagggccgtcattcccttggtctcaatcaactcgtccgttaattgcatcaaggattggctggtcttagggtcaagggctgcagtatgctcatccaagagtaaaagttcaggctgtttcaaactcgccatcaacaaactcaatgcctgacgttgaccacctgataaaagtcctgctggcgtgtccagatgtttttctagaccatttcccactctcggcaaaagctgggcaaattcttccgtctgttgggccaatctgcgtggcagtaagccccgtccctcgccacggtacttagctatcagtagattttctgccaccgtcatccgtggcgctgtacccattttaggatcttggaaaacacgtgacaaatacttagcacgtttttctgcaggccaattggtcacgtcctcaccaagaatatggactgaaccactagtcaagggtagggttccagcaatgacattaaagagggttgacttcccagccccattgccacctaaaatggtaataaaatcaccctggtagatggtcagattgacattgtccaaaatcacacgttcttcatcaaaaccgtttgtcaccaccttggtggcattttttaattcaacaattgctttcatcgtgacagactggctcctttcagaagtttatttttcaactcaggaaccatgaggcaagttgccagaatcatggccgagaaaatacggaggtagctggtattgatcccgagggaaatgaccaccaaaattaagaactgatagaaaatcgctccgacaacaatggccaagaatcgttctaacatagtaaggttaccataaattacctcaccgataatcagactagccataccgaccacaatgactccaataccacgcgacacatccgcatagccttcttgttgtgcaatcaaggcacctgcaagagcgatgatcccatttgaaagaacaaggcctagcaactccattcgacttgtattgataccaaaactgcgtgccatatctggattatcccctgttgcaataaaggcctgtccaaggcgagtatagaggaagaacatcaaggcaccaatcaccaccgctaggctacctagacctagcaagagaccattgacttgctcagaaaaaggaaggaaatcttgtaaacgtttggtattcagtaagcctagatttgccctacccatgataaatagaatgacagagtgacaggaagacatgaccaagataccagctagaagagtgggaattttccccttggtataaagcaagcctgtgacaaagcccgccaaacagccaacaagaactgctgctagagtagccaagataggatgaactccttgcgtcaataaggtaacagcaaccgctcctccaagcgggaaagacccctctgtcgtcatatcaggaaaattcagaatccgaaaggtaacgaatattcccaaacctagtacagcccataaaagagcctgtgaaactgttgatacaatcatatttttccttttctcttatctcttattcgataaccttgcttgctttactaatcacatcatctgacaaggtaattcctaattctttagcaactttttggttgacaacaacggtaccctcgttaaagatttgtacaggtgtatccgctggattggcaccatcaagaattttcgcagccatcttaccagttgccacacccaagtcatattggctaagggtaacagatgcgatacctccaccttctaccatgtcttctacgctagtgaaaatcggagttttggttttatttgccacagatacgacagttgaaaatgctgaggcaactgtgttgtctactggtgtaaagagaacatctgctttactacttgcgacctctactgtcgctgcaatttcattactagaagcaactgcatattcaagaacagtatagccagcctcttctgctgctgccttaaattccgctacttgaatttttgaattgtcctcatttgaagaatagaggacaccgatagttttagcgtctggtgtaatttctttaatgagagaaactgcgtctgctactggtgtttggtcagatacccctgtaatatttccaccaggatttttcaaatccgtcaccaggttggctccgactggatctgttacagcccccatgataatgggtaattctgtggttgcattggcaagaccttgtgcagcaggtgttgcgataccaatcaataattcattgccattgtccaccaattttttactcatggtttgaacttgggattgatcaccctcagcattcataaaatcaatttctaaattatccgttgtggtataaccaccttcttcaagtcctgccttgattcccttataaatctcatctagtgaatcatgggttacaaactgaagaacccctatcttaactttctccgttgatgtagatgaattgttctgctctttctgtgtcataaacaaagcagcaactaccataacagtaagggcaacaattgtagcaagtaaatttttatttttcaacatattcattctcctcgtaaaatacacaatatacaatttctacgtcatcaatatattatcccaccatcgccatcgtttcatcatgattacctcgttttgttaataattgtcaaagtagattgcttttagataaggaacggaggcgcagacataactcaagttaggcaagccgaacgtgacgcaatataaaagcactctacgaagacaatggaaaagcccccgcaggaaaaaacaacctgcgagggcgtcaatgacacggtgccacctcacttatgggaattgtctagaatcctcccatatctcatctcctctaacaaggagttgcactgtaaggtgtgcggaccgaactatcattgttttaagttcatttacgtgactgttttggctagttacttcgttaactctccttgctataccgccagtataagctgcgtcgacctgcctcgtactcagccaaaacagtctacgcaaagtatgctataccaaacaatccttgtgaatttagggcattttaggactaggcagtcgggtgaaggcagtactggtggtacggcaagcacgactaacgacgtcataaaatagacataaatgcacatcagcccatttcataaaactccgccacccgttctcagcaccacaggctccctgaagacttctgctttactacttcttctgattacagatgattatacggtatccatcagtctttgtcaatacttttgattaaattttctgaaaactttttaataccttaagagtctattttgagctattgctcaggatactgccattggattgaataacttctttataccagtaaaatgatttctttctatatctagttagactgccacttccatcatcatttctatcaacataaattagtccatatcttttagataattgtgcggtagacatagatacacaatcaatacagccccaagaagtataacccatgacttctacgccatcctgtatcgcctccgcaacttgtaaaaggtgttcttgcatgtattgaattcgataatcgtcatgaacagtcaaaccaccagcctcatccttgactagctgatctttagctcccaaaccattttcaacaatgaataaaggaatctggtatcgattataataacgatttagtgtcaatcttaaaccaattggatcaatctgccaaccccaatcagaagcttctaaataaggattgaccaaaccacccaagatatttccttttccagatgaatattttgatggatctgctgcctgagtaatactcatataataactgaaggagagaaaatcaaccgtattattttttaataactcttcatcaccttccacgaaagtaatctttatgccattttctttaaagtatcttttggcataattaggataatatcctctaacatgtatatccgaaaataaatagttcaaattttcataggcatgagccgcccaaacatcttcaggattgggtgtcattggataggtcggcatagctaagaccatacagccaaccttacagtcaggaataatttcatgagcaattttggtaacaagactagaagctacaagttcatggtgaatggcctgatataaatcttgttttgaaagttcttcattcggcaagtcaattccaccacttgtaaaaggcaattctaagacagaattgacctcgttaaatgtcaaccagtacttaaccttatctttgtatcgctcaaaaactgtacgagcaaatttttcaaaaaattgaatcatttttctatccacccagccatgatatttccttgccagatacaggggagtttcatagtgagaaagagttacaagaggctctataccattctttagaagttcatcaaaaagttcatcataaaactgtagcccttcttcatttggaaattcttcatctccattcggaaatattctactccaagcaattgatgttctaaataccttaaatcccaactctgaaaacagggctatatcttccttgtatcgatggtaaaaatcaatagcttgtaatttcaaattatcctccgttggttcttgggtagcttcacccagtccaccattggggagaacatcttgaacggataatccttttcctccctcattatatgcaccttctacttggtttgcagctactgctcctccccataagaaattatctggaaaaattgacatataccctcctcgaattataagactgctaataaatcatcagcatagttgacttcctcttttgtcgaaagcaagagaacatccagatattcctgtgtatttgtaacaactacaggagtcactatatcgtacccttctgcgacaagcatttctacatccacttccagcatcagttgacccttttcaactttttccccatctgaaacatggcttacaaaacctcttccttttagctcgacagtttctaatccaaagtggataagcaactctaccccttcatcacttgttaaaccgattgcatgttttgttggaaaaagactggtaacagtcccgtcaaatggagcatagacttttccatccttagggataattgcaactccttctccaagcattttttttgaaaacgttgcatcatttactttttctaaagggagaatttgacctgaaagaggagagaagacattttttctacttgaaatgccaggtgctactttttctaaattaactgttgacgtttcttcatcaatacctaggaaataggccaaaataaatgtgacaataattgaaattgccgcagcaatcatagcattagtaatgtttgaagctgcttcagagtaaataaattgtggcaaagcaatgagagaaggtactgcaaagaggtatgcttttacacctgtcaaaccaacaaataatcctgctagaccaccaccaatcattgctgcatacaatggttttttatactttagagtaacaccatataaagcaggctcagtgacaccagcaaataaagctgaaaatccagctgcaaaggctatttgttttgtgttactatttttactcttaaatgcaactgcgatagaagcggcaccttgtgccaagttagaacctaacatcgctggtagaatcaatacatcaggtgtcgcgattgaagctgccaagaaaatcggtgcaaaagcccagtgcataccggtcataacgataaatggcatgattgctccaagaactgctaaagttaaccaaccagctacaccatgcatttgttcaaccaattgcgataatccttcaccaacaataacgccgagaggtccaacaagaactaaagctatgaaacctgaaacaagcaggaccaaggttggctgtaagaaacttttcgttacagctggagtgaccttgttaaaaacagcttcaatatacttcattagccaaaccataataagaattggaataactgatgaaccatagctagcaggtgtaacaggggcacctaaaaaatgaagtggatcacctgaagataccatttgaacaaaattaggatgtagcaaaataccagcaaccgacatagctaaagcaggtgtaactttgagtttttgtgaagctgagtaggccaaaaaaatcggcataaagtgatatggtgcatctccaaaaaaggctaaaaatgaaattgattgggaatccgcttttaaaagccccagcatcggtaagacaatgactagaacttttatcatacctccaccaagcatagctggaataagtggtgtcatagagccagcgatatactcgatgacttgttctaagacatttgcttttttaagctgttgaactgaatcagaatcaaattttcctaatgcagtaaattctttatagtaattagctacatcattacctaagatgatttgatattgtccattttttttcataatgccaatgactccggaaatggatttaacacgttcatcggacacgatattctcatctttcagttccagtcgcaatctagtaacgcaatgggttgcacgaagaacattcttttctcctccgactgcccctaggattgccaatgcagtattcttgtacttcataatagactccttatgataaattttttgttaaacgccgaatgtgagcaattaaatagactaattcacttggactcagtagataatcatattctaaccgaataaagtccgctactcgagttccacattggtactctcttggatacttctttttcattaactctaaaagatccacatcatcttcatcatggtattcattcccctctaccaaacgatgagcaaacaacttaacatgtgtgatgaatcggtagtaatcaatagaatcttgattgaattctgtagaataatagtcttgaataatttgttcaatcttcatgataattccagtaatacgataagattcttgaaaaatattttccaaattcgcattgacaaaatgcaaagcgatgaaggctgcttcatcaactgggagttcgacatgtaaatctttttttatgatggataatgcttttttccccagttcaaactcctctttataatatttggcaatttcccatctaagagggttcgtaacgactactccttccttatgtctttctatactagaattgatatgatctgtcaaattgatgtaaataatctcatcaaaatgatttccaagtgttatctttcctaaatttattattttctcacaaacataaaccaactcaataggaacatcgataaatagttccgtaaagcgattcatattatcgctattcttgagcaaaaaacttttttctatcgaagaaggtgggatcgcatctccgaccttctttccaaatgcaattcctttaccaaacaacaagatatcaacgttcttattattttgtgctatgactgcattatgatttaatacacgctttatgatcataaattttcctttaaacttaaaataaaagaacctacttaaaagaaatcgacatatatcgtatcgattcatttaaataggttcctgctcgccttaaagcgataacatccttttatttcaattattagttggtacttctagcttaaaaaatttaataactctgtaaccattttcaattttaatataaattaaagaatttgtcaataatttataaaaatataagaatacttcttttagtccccttcgttaaaaagtcactgatttatgatatactagactgagttatagctattagaaagaggaaaaccatgtcttttgacggattttttttacatcacatgacggctgagttaagggccaatttagaaggtgggcggattcagaaaatcaaccagccctttgaacaagagattgtcctcaacatccgcagcaaccgtcagagccataaattgcttctgtccgcccattcggttttcggtcgggttcagctgacccagtcggactttaccaatccaaaagtgcccaatacctttaccatgattctgcggaaatacttgcagggagccattatcgaggagattcgtcagttggacaatgaccgtatcttagaattttcggtgtccaacaaggacgagattggcgaccatatccaagcaaccttgattgtggaaatcatgggcaagcacagcaatatcatcttggtagataagtctgaacagaagattattgaggctatcaagcacgttggtttctcgcaaaattcctaccgaaccatcttgccaggctccacctatattcgtccaccggagacgcattctctcaatccttatacggtgtctgacgagaaattgtttgaaatcttatcgactcaggaactgagtccaaaaaatctccaacaggtctttcaaggtttgggtcgggatacggcttctgaactggccaatcatttgcagatagaccgcctgaagaacttccgtgccttttttgaccaggcaactcagcctagcctgacagacaaatcctatgctgctctgccatttgccaatagccctgaaaaccagccacactttgagagcctgagcagtctgctggacttctactatcaggataaggcggagcgggatcgggtggcccagcaggccaatgagctgatcaagcgggtagccagtgagttggagaaaaatcgcaagaaactaatcaagcaggagcaggaattggcggatacggagacggcggagttggtgcggcaaaagggcgagctcctgaccacctatctgcatcaagtgccaaatgaccagtcgagtgtgcggttagacaactactatacgggcaaggaactggagattgagttggatgtggctttgactcctagccaaaatgcccagcggtacttcaagaagtaccagaaactcaaggaggcggtcaagcacctgaccaacttgattgaggagaccaagtcgaccattgtctatctggagtccgttgacaccatgctgggacaggctagtctggcagaaatcgatgaaatccgtgaggaattgattgaaacaggctacctcaaacgccgtcatcgtgagaaaatccataagcgtcagaaacctgaacgttacttggcaacagacgggaaaaccatcattctggtaggaaaaaataacctgcaaaatgatgagttgaccttcaaaatggccaaaaaaggcgaactctggttccatgccaaagacattcctggtagtcatgtggtcatcacagataacttggacccaagtgacgaggtcaagacagacgcagctgaattagctgcctacttctccaaggccagacattccaatctggtccaagtcgacatgattgaagccaaaaaactccataagccaacaggtggcaaaccaggctttgtgacctaccgaggtcagaagaccctccgtgtcaccccaactgaagataaaataaaatccatgaaaatctagttcatggatttttctgtattgaagcctactccgccttatcaatatcttctctaacttccttagcattgaacttagcaaaaagatattggcggtcttggactgggaagcgttggtctagttgatctactggccccacttccaccattccttctgagataacataatccatgacatgcccgccaaatgtcaaatcatccgaaataaaatgcaaatgatagccagccacactgaccccgtgaaaaatttctggtgtccaaataccaacaatggtacctgaaatattctcagcggtatactcaggctgacgacttgccacctccgcaaaacgaacatcagaagccgattttggaatcatgcggacatgcatccgtgaaaacgtccctttgattttgatggagcgaaaaagattttccccatcataataggattcaatccgctgatgcaattcatcgctggtcatttcaaagcgttgcttaaaaatcacttctgcttcatggaaaatgaccgctgcataaggaaccttcatctcagcaggaacttcaaccacttctggtttctcccctgctcccttggcctgataagcctttccatccaagacaatcagctcgccatcaatggaatccagggttcccaagcccaaatcaccatgttccaacaattcgccaaccgtcaaggagccgccatacagtccagccattaaggcacctaaggtattgtattgaaataatcgatttacttgcataacctactcttcattcaaaaattcttgcatggctaaatcgtctggcaccaattggatataacgactagcttgctcttttgcctcatccaaacgaccaagttgacgtaaaaccgctacgtaatcagccaaaaattcaggattctcagcaaattctccagccaattcatcgtaaagctcaatagcttcatcgtctctttctagagcttgataagccttggccacattccagcgagctagaacgttatctacctcttcatcaaataaagccacaacctcttcaaatcgttcctgctcaagatacagattggacaagcgcagagctagttcgttactatcatctgctacctcttttgcccgtagaagataatcttctgcccccgcctcatcatgcaattcataggcatactgagaagcctggagcaagagattggcgtcaaaatcatttttagccaggcctttttgagtcataaccaaggcatcatcaatcttatgctcgacatgaagcgactgagcataggcatattcatagccctcaaaatcaggattgatggtatccaactgcttgaaatagagatttgctttttggtattcttctcgttcaaatagcagagctgctaactcaaaaaccgtctgatcatcgtattccaactcaacagctttttccaaaaattcaatcgccgcttcaaatttccccaaacttgcataggcaataccaattcgctgataggtagaaactcccgttaattcgtagatctcacgattatccagctgggcatagtaggaaatagcctcattaaaaagctccagttccatatccaattctgctaagccaaagaggatgatgggttcatctgataagtgacttgcttctaacaatttttcacgcgccacatccgacaagccttctgcctgatacaggtccgccttaaccaacaaggcttccacatagacagaactgtcttccgaaatttcctccaagtatccaaaagattcttcaaccaagccatcttcaaatgctatttgggcaagattgatcagtacttcgggaaattcttctttgacctgctcatagatttgtctagcctgtgggaaaaaaccaatgccttctaagtaggctgccaaggacaaaagcgtttcgctatcatcttgcaccaaggcgcgcttgaaatacttatctgccttgtctaaatcctgttggtccaaacaaaccaacattttttcactattgttcattcacaacctcattttcttcatcttcatacaaaccactgtgtgccttgtaccattcaaatgccgctttcactaaaaccttaatagaggcatatattggaattcccagaagaactcctaggacaccatacatctgaccagctgtcaataatacaaacaaaatggtaatcggatgaatacttagggagcttccgataatcaatggtgtcacaaaacgaccttctatagtttgctcaatcataaagactactaaaacctttatcagcatgattggaccagcaatcaatcctaaaataacagctggaatcatggccaagaaagaacccaaatacggaattagattgaggaaaccagccatcacccccaaagttattggatagctaagaccaatgattgagaacatcactgaaaacatcagggcaacaataatcgcaacggtcacctgaccacgaacatagtttgataattgcccattcacatctgatagtactgttccaatcggttctctccacttggttggtagatattgggtgatgtgtttattcaaatactgaccatcccgtaatagataaaagagaataaagggcataatcaaaatagcaacaataatctgtgaagcggttgaaatcaaattacttgcccagttcacagcgcttgaagaaaacttctgagcataggcaacgatctgatcattgaccttatttaacatctccagagctgttggtctaaattgttcaaagcgctgatcctgtaggagcccagttacctgtccttcgattttctggatattcgaaggaagattttgcgcaaaagatgtcacttgctcttgaatactcggaattgccaccgccagtccccagataatgagaagactgattaaaacaaagagaatggaaataccaactgtacgagaaattttatgcttttccatccagtcaaccatcggatttaataggtaatacaaaagacctgttaaaatcatcggtaacaatacaatttctaaaaagcttcctattggtctgaataaaaaactaattttactaaaaataaatatggtcaaaaaagtcagcaaggttaccaataaaaatgtcaccgcttggctatttaaaaacaagcggaaaaaccaagtcagactaaatttttgatgcttatcctccatctgatacactcctagtctttttttctattgtaacatggagaaaggatttttgtaaaaatcaactacagaatctatacgactttctcagaaaaacatggtataattttatcaatcatttccaaaaaggagaatcctatggctatctatttcggtacctatacaaaacgtgaatcaaaaggaatttataaagcaaattttgactctgaaacaggacaacttagcaatctagaattggtcactgaagaacctaaccctacctaccttgcctttgataaggccggacatctatactccgtcggcgctgaaaatggtctaggaggtatcgctgcctttaatactgactatactctactcaaccatgttgtatcagagggcgcaccactttgctatgtcgctgtagatgaagcaagagatttagtttatggttccaatttccacaaagggcaactacttgtttataaacgtttggcggatggttcgctagaattagctgatgtcgctcaacacgaaggatctgggccgcacgaaaaccaagcttccgcccacgttcacttttctgatttgacgcccgataaatttttagtaacctgtgatttaggatgtgatcaagtggtaacctataaggtatctgaccaaggaaaagtagagaaaatagcaacctatcaggctgcgccaggaagtggtccacgtcacattgtcttccatactgtcgcaaaaatcgcctatctcatctgtgaactcaattcaactattgaggtgcttatctacgacggctggggacaatttgaacacctacaaactgtctctactctcccagaagaccatactggtttcaacggtactgccgctattcgcatcacaaaggatggtaaatttatttatggatccaaccgcggaaacgactctatcgcagtctacaaaacgcttgctgatgccagcttagaattagttgaaatcgtcccaacaaatggaaaaactcctcgcgatttcacgcttagtcctgatgaaaagcatttgattgttgtccatcaagattctgacaatgcaactgtattcaaaagagatgccgaaaatggctgtttgactgagctttcacacgatttctatgttcctgaagcagtttgcgttacatttttataagtcgtttcagttgtgaaatccgtacagttttggtttaatagtctcataggaggtgatttcaacatgaatccagtagatctttttaaccaagtaaaagaattgattgcaaacaaagactttgatggtgcaaaacaatttatcgaagaaaacaaggaccaattcggtgaatacttggaacaagcaaaaggcttgttatcaggttctgaaggtgttaacggtcttttagataaagttaaaggcttgttctaatacatgtaaaaactaggctgagaatgttcagtctagttttttgtttgttcaaaaatatttgttatctcttgcaatgaaggaattatccaatcgctcttcaatttttcattttcactggcatgcttcccaaaacctgtcagtatccgtacagtccacattcccaaagatttagcaggcagaatatcattatcaaacctatccccgacatagacaactctatctgcagggatgtttgttttttgcaaggcaagtgtgaaaatagctgtatttggtttagatagcccaacctcttcagagaggatgatgagttgaaaataagactcaattccccactctttaagcagttctctaatactactagactgattggcaataatccccaatcgatagttttgtgataacttctctagagcatctattgtttcaggatacaagctcacaccctcatttgtccacaaaggacgtggctcggtcggtgcaaaatagtgccaggtcgaacgaatgggatccagcgacttatgagcatactccaccattttctttttataagaatctgatgaaacctctatatccagagactctaacttcttcacacacttgtctatataataaccataagcagcctcttcatctaaaagcgtcgaacccaaatcaaaaaatatccactctatcatcccactctccatctcttttcaaaatgagaatacttaagttgatctgcctttttagaatatcattttatcaatatcaaggcaaagaaaattccctaggaatttcagtctagttttctattcattcttaaaaatagttaggacctatcttgtcatagattttcacgcatcaatagacatctttacgatgtccaaactcaagtgctaaaataaccaacttatcatcttgaatatcgcaaatcagtcggtaatctccgatacgataacgccactcgttagcatgattgcctgtcaaacctttaccattggcgcgtggattatcagtcccttctaagtgtttatcaatccaagcaaacaacagcctctgaatttgcctatctaatttcataatttgcttttgagcctttttagaatactctaaatgatacatgctataatcctagctctttcttaaaatcagcatgactaattgtttctggatctgctttgtactcatcataagcttgatgatagatttttaaatcatactcatcttcaatatcacgctccaaagctttcttaaaaaggctagaaagactttgacctgttaattgtgcatagcttttaaagaatacttcttcttcttgatttaatctgattgtcactgtactcatgatattcacctcgcttctttgtgttacattgtaacacatttttaaagtatctgtcaatctatcaaaaaagtaccttgggatgatgccccaaagtgccttatatcaaggctttacagcccttaaatcatataaagtcaaagaacaagtccgaatattttcagacttgttcttactatatccctcactatactagctcggggataaattagtacactgtactacgaaaaacaagtctggaaatttccagacttgttcttactataaccctcgctatgctagctcagggataaaacagtctcccagactgttttattttttcaagttgtagaatgagttcaagcctttgtagactgcaacttcaccaagttgatcttcgatacgaagcaattggttgtatttagcgatacggtctgtacgtgacaatgaaccagtcttgatttggccagcgttagttgcaactgcgatgtcagcgattgttgaatcttcagtttcacctgaacggtgtgatacaacggcagtgtagccagcttctttagccatttcgatagcttcaaatgtttcagtaagagtaccgatttggttaactttgataaggattgagttagcagcaccttctttgataccacgtgcaaggtagtcagtgtttgttacgaagaagtcgtcaccaaccaattgaacgcgtttgccaagacgctcagtaagagctttccagccatcccagtcgttttcatccataccatcttcgatagtgatgattgggtatttgttaaccaattcttcaaggtagtcgatttgttctgcagatgtacgaacagcagcgccttcaccttcgaatttagtgtagtcgtaaactttacgttctttgtcgtagaattcagatgacgcacagtcgaaaccaatcatgatgccgttttcaccagcttcgtaaccagcagcttcgatagcttcgatgattgtttcaacaccgtcttcagttccttcgaacttaggagcgaaaccaccttcgtcaccaacagctgttaccaaaccacgagctttcaagattttcttcaaagcgtggaatacttcagcaccccaacgaagaccttctttgaatgaaggagcgccaactggcaagatcatgaattcttggaaagcgattggagcgtctgagtgagaaccaccgttgatgatgttcatcattggagttggcaatactttagtgttgaatccaccaaggtaagtgtaaagtggcacttcaaggtagtcagcagcagcacgcgcaacagcgatagaaacaccgaggattgcgtttgcacccaatttacctttgttaggagtaccgtcaagagcgatcatagcgcggtcgatagcttgttgatcacgaacgtcaaaaccgatgatagcgtcagcaatcacgttgttcacgttgtcaacagctttttgagtaccaagaccaaggtaacgagatttgtcaccgtcgcgaagctcaactgcttcgtgctcaccagtagaagctcctgaaggaaccataccacgtccgaaagcacctgattcagtataaacttcaacttcaagtgtagggttaccgcgtgagtcaaggacttcgcgagcgtaaacatcagtaataattgacattatattactctcctttgagtttaaaattgttacatagctatcataccctaaaagaagggatttttcaagaaaaaacaggttattttactgaaagaaataatgtaaacgccttccttttcaaagttaactgagtatgttatactgaaaccatgaacgatttaaatactaccatactacagaaagcctctggcgaaacacgattgaatccagatgaacagcgtctatacatgggaacctatcgcgaacgggttgtcctgatcgtttcctttgacgatttgagtagtgaagtcgtcggaaataagttcgatacaatttgccaaaaactagcaaacagatactctcctctattcctcaaactctcgccagccctgtctgacaagcaacaaatttcactactaaaaattgctcagacctttggcattactaccgctatcatcgatgaaaaaataggacaatctccctacgcacttgtctttcacacaaatcacgctgtggataatgaagaagttagcttagaatccatatttccaaatcttatctcaaaaccagaagaaaaaaaggaagatgcaaaaccttccttctggaaaaaattatttggttagacttatttaacgataaagcagtataaatattaaagtaaaaataatacaggttagacaaaggattcctagcaatctgcctctttcatttttttcattgaaaaagaacattgctccgtttgcctttattacattcatttccgttactctttctttttcggaaagtctcataacggatactagctttgcaagacaaataaaaataaataagataatagccacatatttcactaattccatctttgttggcctcctaactgaagaattcttgccacctgctctgccgtgcggaccaggtttttttctgctttttgaagcgtgtcctccaaactttcaacgcttgcaattatcggaaaagcggcgcagatattttcaaaaggaaactcgggaagatcgtctttgaggctaccacaaattgcaatgatgggaatccccgtcggcgtccgtctagctactcctattggagtcttccctgataagctttgggcatccatccgcccttctccgaccacaaccagacccgctttggtgacgcgatgatcaaagtccaactgatccaagacaaagtcgatgccttttcgaatgcgagcaccagcaaattggactaaacctgctgccatacctcctccagcacccgctcctgccaaatcgagtagcattggattaactaatttataaaaggactccattttcttgtctactagttcaaattcagcagaggtaagacctttctgacctgcaaaaacaaatgtggcacccgctggtccgcaaagcggattctccacatccgttaccaaatcaatcctgacctgagatagatctaccaacatatcctctgtggaaaagctgacaatctccccgatatgagctccaattgcctctacttcttttccctctcgattataaaatttcactcctaaacctgccgccattccgataccaccatcatgactggcagagccacctactcctataaatatgcgtctaacaccattttgaacgagctccacaatcagctccccaaccccttgtgtcttaataaagagaggactccttctttcatgcgggatacttgccagccctacaatctcagccatttcaaaaaccgcaagatcatctttaaccgcataggaaaccttaattttatctccaaatggacctgtcacccaagtctgggttccatccaaggataaggcttgcattagactctcaactgtcccttcgccaccatctcctaggggaattaagtcataccctgcttgtgggtaaactttagaaaatccttttttaatcgcttcagcaacctttgtagctgaaagagactctttaaatgaatccggagcaatgagaatatgcatggtactaacctcctttatattattagtatatcacgctcctagtcagctttcaataaatcttttctgtttttcatcgtctgtgttatactgaaagaaaggagataagtatgtatcaaactatattatttgacttagatggaacacttactgattctggacaaggaatcttaaactccgtcgcctacgcactagaaaaaatgggaatcgaagaaccagatacagccaatttaaaccgattcatcggtccgccactctatgaatctttttctcgattctaccaactcagccctgaagatacacaaagtgcagttgatgctttccgtgtctattttaaagaaaaaggaatgtttgaaaatcaactctatcctggaatcatccctctgcttgaagaattgagaacggctggaaaaacactagtaattgctacctcaaagccagaaatatttgccaaacagattctagaacattttggtatctcacactactttgatgtcattgccggtgctagtctggatagtagtcgcatcagtaaggcggacgtcatctgctatgctataaatcaattagaagcatttccaaaccatgctgtgatgattggagatagggaacatgacattgaaggagcacgcatgcaccaacttcccgccatcggtgttctttacggctatgggaacaaacaggaatttgaaaaggctggggccaccatgatagtcgaaaccgtccaagatttgaaaagggttttactgacaacagaatagaagatgctgggcaaaaagaccaacctcgcttctcagggttcgtgtcaacatctcagcgcagtggttgattggcagatttgttcgtgttttacactccaaatctgacctctatgactgatgcgaacagagttcgcttcatttccaacctcaaactgtctcccagacagtttgagctgtgcgggggtgggagtgaaacagtctggggatagactgtttcagctcaacaactagaaataaagacttgttgacgaactctttttctaccatttgtcaagtctatcaaggctttaagcaaaaaaataaagcataacagtagctattttgaggctgctaccttatttttgtcactaatttagctataaaagggcatgacaaaatgacaccttatctagtattttttgaaataaggtgttacaatgatagagcataaacagttttaccgattttgggttgaagcgtaatcgtaaagtttgttatgcataatgaggtaatacattgtccgaatgagacgatgtatggaggcaatcgtgtgcggcttcgttgaagtcgtttgcgattgtctttttcgtttctcataaaagtctgcgatatggcaaggattggtatgactggctgaagcgatattgtggatacacttgaacagaatctttctagcgtagggattgccacgcttggtaatgtgttccttagcgaggaagttaccagattcatagtgtctcaggtcaataccgataaaggcattgatttggttggcagactgaaaacggcgaatatctcccagttcaccaataatacttgttgcagtcgtctcagctattccaggaatagagagcagaatgtcatattcaggtaatggctgagctagttccaccatttggtctaagactgcttgtctctgttcagaaagccgaagcaattcttttgcatagtaatgcacctcttccagtattggagaggttttcttgacggcacaatacgattgattagctagtgctgtcagcttctcagctaagtacgccacacgcttgtcagaaatccgttttgaggtggactgacgaatgctctttgatagttcattcttgcttaaatcaagcacgaagtccttgcaaggaaaggttatgaccaagttccagtattgttcgccagttggtgttgacaagatattttccaattcagggaaagtgacttgtaagaccttgtgcagacggtttttagcccgaacaatgtcctcggtcagattctgatagaaacggctgagatcccgcaagttttggtagacttcttcttggacataagtgggtttacgattcagcacaaattgagattgagccagtttttcagcgtcaatgtgatttgttttccgcacacgcaagctatccagttgcttcttggcttctaagggattgagtcgtgtataagcgtagccatgttcatccagaaaagcttgaagacgacgagaatagacgcctgttgcttcaaagatgatttctggcttgtggacggttttcaaatcgccaagtagccgagaaaagccaatggcatcattggacatggtgtagttatgtaccttctcgccgttgactagaatggccacttctgaacttgccttactcacatcaatcccaaaaactactcgcatgatattacctctttgtcttgaatgattccttgttttagtgatgtcattttcaatactcgacgtctggcgtcccacatactttgataacattctttctaaaacaggtgtcttgccagtttttgttgcgacgtctagcgtcaaaagagttctcgacttaacaagacacctctactttatcataaagaaaaagtagtgagtactttctcccgtcggagatttcctcactactaatcttagtatgtttttgattagtcgagttctttcccgctcccattatttactatctaaaatctctattagtttatagagatttttttcatttatttggtagggcacctgttcttggacaatcggtttagcacagaaagctactccaattcctgctcgttgaatcattggtagatcatttgctccatcccccatggcaatcgtttgagatagactcagcccattttctgccgcccattcttctaaacatgcttttttagtatctttcgttacaatttcacccaacacttgtcccgtcaatactccatctactacttctaatcgattagcccgaacatagtctaactctaactgtgcagctagtcgatcaactgtttcatgaaacccgcctgaaacgactgctaccttatagcctcgcatttttaattctgagactaattctgctgctccaggcgtaaagtggatttttttgataattcgatcaaacacagaaacaggcaatccctttaacaacgccacacgttcacgtaaggcttcttcaaaatccaattccccacgcatagcacgttcggtaattgctgcaacttgcgctcctaaaccggcctcttctccaagtaaatctattccttcttccaaaattaatgttgaatcaacatccataactaataatccagttgtcatctccaatattcctttcaatgtataaaaataaaaagccaaatggctttttatctagtagcgaatggcttcgcgagttttttcgtatgaacgcacaaaacgctctgttacaccaggttcaactgtttccagagcaaatgaaatttcttcaaatgctgcttggtaatcaaaatccttttcaaaaattgataatgaacggttaaatgctttttgcacactttcatcgaatgaacgataacggttagagtattgtagcaactgctctgtcaaagtcgcattttgcacaatcaaatacgccaactcttccaattgattcatatcatacgttgcattttccaacaaacggttaacaacttcgatattgattcgtttatagtctaactcggcaatcaaggcttccacatgatcgctcgttctaaagaagtttgttaaaaattcagctggaattcctggaaggttgcgtttttccatataacgcttaagggtatgcaatttgttgatataaagtgtagctttcttacgcgctgtgttctctgacaattcttgtgatttaagatagtcagctaaaacaagctgctcctcttcgatttctttcaagcttgccaatgaatgatccaaacgctcttctaaaatagaatatgcaacttgtggattttcaatgtcttccacactttctgtaacaacaatctcaatcgattccaaacgagctttaagctgattgatacgtgaaagtttgctatctgccagcaagtaagttgcatttaggcgttggctttcctcatccaagagctgtgtattttggacaacatgctccaagaattttggcaagtttttactaatcttaacagcttccttattcgcttcgatttcacgattgaagactttatacaaatgatcaatttttgcttgaattccctcattttcagcttctgcggcatccaaatcaaaggaaacaatcaaagcagtattttcacgaattgaaacgcgaatattttggaactgtgactcgatgttagcttctgtgaacaaataattctgctcaaccagtttacgataacccgactccaaatcttccaattgctctgggaaatcttttgtaactcgttcaatcaaacttggaatgcgatccatgatttgattgagggcaatcatatgctcttcagtcttatcaaggatttcagaagcttcaatcgggtcacctgaggaattaagcatcacaaattcagaaaactcaacttcaatatttttcaattgtttctcaagttctgatagtgtctcaccgtagctatctggattttcacgaacagcttcctgtaaactatcgaacaagtttaacgcatgttttacgcgaccagagtttttctcttcttgctccttcaactccatcaaaccttgacggatagaggcaatatcttcttcaattaaatcaatttggctgtcgatactgtcgatagcgttctttgcactcacaaagcgaaaggcattgttatagccttctgcctcaaagatatgattttcaatatcggcaaatgaattgagcgacaaatcaacccatttttgattccattcacggaatgacacctgactttgaccaatcaaatgaagtgctttgacagtttcgacttcttcattaactggaaggttaaatagctcttccttacgttcttccaatgcaaccaaaaggttgtcatttcgtttacgaacaatcaggcaagctacataggcaatgattaaaataataacaatcgaaacgattaagatgattgttcctgtaggcatgtaaatctccttagctcatagtaattactagaaaatatcgcttaattataccataaatctctagtatatgcacttgtttttttagtttttagacatccaatgttgaataaacagcattttcctcgataaactctcgacgaggttcaaccttatcccccattaacatgtcaaaaatcttatcggcttctgccgcatcatcaactgaaacgcgtgccatgagacgattttcaggattcatcgtagtttcccacaactgatgatcatccatttctcccaaacctttgtaacgttgaatcgttggcttggaccgtcccgtactatgtctttctaaggcatcttgcaattcttgctcttgattaaccccaggttgaatatattcttttatctcacttccaaccttgataccgtaaataggtggttgagcgatatatacgtatcccgcttctacaacaggacgcatgtagcggtaaaataatgtcagaaggagtgtccgaatatgggcaccatcgacatcggcatctgtcataatgactaatttttgataacgtgccttgctaacgtcgaaatcagcaccaaagccagttcccatagctgtaaatagactacggatttcttcgttggccaaaatcttgtccatgctggctttttctacgttcaaaatcttaccacgaatcggtaaaatagcctgaaattcgcggtcgcgaccggatttagctgaaccaccggctgagtccccctcaacgatgaaaagctctgtcttcgctgcatcatttgaggaacaatccgctaacttacctgggaggtttgaaatctcaagacccgatttcttacgagttacctcacgcgcacgcttagcagcaatacgagccttgcttgccaaaatacctttttcaacaatccgtctagcaatctgtggattttccaaaagaaattctgcaaaggcatcagagaaaaggcggttggtaattttgaccacttcactattcccaagttttgtcttagtttgtccctcaaattgaggacctgggtgcttaacagaaatgaccgctgtcaaaccttcacgcacatcttcaccagtcaaattatcctcattttctttgagaattttatttttcttggcgtagtcgttgataacacgtgtcagagctgtacggaatccttgctcatgggtaccaccttcatgtgtgtgaatattgttggcaaaactaactacgttttcatgataactcgtcgtatattgcatggcaacctcaacggtaatatcatccatttcaccttctgtatagataggggtctcaaaaatgacatccttgttctcattaagatactcaacgtaggaagcaataccaccttcatagtgatattcctttgtttgctctactccctcacgtttgtccgtaatagagagatttaaaccacgatttaggaaggccaattcttggatccgcttatttaattttgcaaagtcgaactcagtcgtctcagtaaaaatttctggatcaggtgtaaaatgtacagttgtaccagaacggtctgtttctccaacaacctccaaatctgcaacgacttcacctcgtttatactcttggaaatatacctgaccatttttgtagacatggacgtctagctgagtagatagggcgtttacgactgatgaacctacgccgtgcaatccacctgagaccttataaccgcctccgccaaatttaccacctgcatggagcactgtaaagacagtttctaccgctggacgaccagttttttcctgaatatctaccggaatcccacgtccattatcaataaccgtgatggagttatctggctcaatataaacttcaattttatccgcaaaaccagccagcgcctcatcgattgagttgtcgacaatttcccaaaccaagtgatggagaccttctttagatgttgagccgatatacatccctggacgcattcgaacagcttcaagaccttccaagacttgaatctgactggcatcatattcttgagccttctcttgtaaatctttgatttcttctgtcatttcttttccttattttctatttgttgctccttaaaaatagaaaagccaatccatctggataaaagcgaaacatatttttagagcaaaaatcattctaacgaataccctttattataccatattttctaatattttgatagaaaaaagaagaggaaacattagctccatcttcttcattactttaactatgataaaccattgtttgagctaggctttccccatctccaccaaataaatcaaccaatttataggcgaaatccaaacttgttccagcacctcggctagtgataattggaccatcaacgaccacatcctcttccagatgaatacctgacggaatgtctttttctttccctgggaaacatgtatagtgacgactatctaacaaaccagccttatccagaacaattggtgccgcacaaattgctgctactgattttcctgatgcaaccgctctttgcaattccgtaatcagtgactctgaatctctaaggtgaacagaacctggcattcctcctggtaaaacaatcagatcaaaggaagacaggtccccatcaaagacttggtcagtttgaacacgaataccgtgcgatccctccacttcatgactatctaaaccaacaatctgacagtcaaaatgagctcgacggaatacatctacagaggccaatgcttcgatttcttcaaaaccatcggctaaaacaaccgcaactcttgtcatataaaccaactttctaacgttttatcgtaatttttctatagcgacgtgatcgatttgtttccttctcatcagctagtcgtgactgataccccattgacagcactagaccaacaccaatcagatttgaaaccatggacgagccaccttgggagataaacggcaaaggaatacctgttaaaggtaacaaaccagttgcagcgccaacattttcaaacacatggaacaagagcatcatgatatagccagttgatatgtaggtgtagtatcgattgtttgacttcaacgttacccgcagcattcgataaatgagcaacaagtatagtccaatcaataccgtcccaccaataaaaccaaagtcctctccaatcaccgtaaaaatcatatcactttctcgaacaggtataagaagatttgttttattgaaacctagtccttttaagccaccacttccgatagctatcaaactttgagcttgctggtaggtcgttgattgggcatttttaaagggatcaagccaggctgcaatacgattgattttataagtatccatccccaaattgtggagaaatgttgttccaccaggagaaataaaaatcagcataaatccgccaaccaaaacgatacctgttaaggcagtcggtaatagaattttccaagaaactcctgataatagaagcattccgctaaagattgctacaaatactaaggaagttcctaaatctttctgtaaggccaacaaaatcaggacagggatagtaaacagtgtcatataaccaatcaacataaaatcctcacgaatttttcgatttggataatatttatgaaaggtgacaatcacccttgacaacataatgatgtaggctattttcataaattcggatggttgaaaaagagtcattccaccaatcgttacccagttttttgctcccgttgatgctactaagtctggactgtagaaaaacaaaggcaataccataagtcctagcccaagtacgtacaagtaaggtgtgatttgccacagaaacttagtggaaaagaacatgaccaaaaaagctgccactgttccaattcctatccaagcaatttgttgaccaaccatctgtacaacattatccggataatcttgactaaccgcaatgtagagagaaataatccccacaactaataaaaaaaagaccggtaaaataagtgagtagtctactcgactatcgattgttcccctatttttcatcaatttcctcatactttcacttcaaattcttactcgttccattatagcagaaatcatctctcattgaaactaaaaatctagttacatcagtggggatacgatttatactcaacgaaaatcaaaagtagcctaggaaacgaagtcgaagatagaactggagttcatccaggcaagttgacaacggataattttgattttcgttgagtattactagtgcacaaatcataaaatacgtatatcttcataccttcgaacaggctgaaatataatgctttaccttcacacaccccataagtttgctcaattcatgagtatgtagaccaatggcaatcattttggcaatcacgcacgaaaaagccctctcttatttctagagtcaaagaaaaaatggtccactggaccataactcgctcttttattttcaagctcgtgaaaaaacagtccgttaaggactgtttttttatttgagaccgtattttatacccttttatttattatcatttttcattaaataataagataactatataaatagaagaaagattttattaaattcttatatattcttatcaattatcatcaatcggaactttttccgttactaaaacaaagattttccccacctattccaaggaataaagattaagttattttatacacttttatgaaataatatacaaaaagttggtattgccagctttttttaatgtctatttcaaattttacactattggtatttttattattttttatgtatcaattttggtcaattttgggggagagatacacaagaggattgacaccgttattttctgcatgtgctaacattctaaaccaggggggataaagaaaaagtctcttgtcataaattctacaaaatttttaccccctttttgtctaacggttcccgacttggaagaagttcccttactcggttcccaatcatttgaacatatttcaacagggtaggggggtaaaatataaaatcaacaaactattataatctaattcgtttttgacttacgataaatgtatgctagatatattttccgatgtccctttcccgttgcacgtttccccagcagaaaagcggtttgtttaggcatgggggcttatttatactagactactatcatcagtgtaatagttgtttataatatttttcacgcgagaaaaaatgtacaatgacggcgtgaagtccaaaggcgatagggtggtagggtacacccccctatcttccaaatgcactacagacaatagataagcccttaatactaacatgtaaagggcttaatggttttatattcttttttgtatttttggagtggttttcgtgttcgttgaattagtcatatcttatattctgtctaattatgtttcactctctaaactcaatactatcaaggcttttagctattccttaaataattactagcattttcttcattatgtctaattaacactcgatatttcctttaaatgtcaaaattagccatcttagtatctaggtcatcttgtctaactcctatgtatattagcgtgattgctgggcttgaatgattaaatatagacatcaaatcagctacattcttatactttttataataatgatagccaaatgttttccgcatggtatgagtaccaatattttctatacctaaatcattcccagcggtctttaatatccagtaaactgtacggcggtcaagcggtttgtttacaccgttacggctttgaaaaagataatgatggagcggtttgccttctacatacttccttaactcattctttagggttcgggtcattttaatagttttctgtttaccagttttttgttcccgtactctgatgtgccagccttggacgtccttaactcttaattttaaaatatcgccaattctaaaccctgtgtttattcccacaagaaatagtatatagttcctttcattccatgaccttagatagtccttcatggcttgaatatcgtccttgtcgcgtattggctcaactgcattcattcgcttcttccctttcttcctcacgcgcattcagattgtcatattcactagcggacttattcgggaaatagtgacgctctaagttttctaaccattgggcgtgcccttccatcattcccttatactttccatcggttcgcgttctgaagttctctacattggtttgcttcaataattccaccttctttctgtattaaaattacaacaccttacaacgcttaacaacacttagaattataaagtgttgtagcggaaacccttggggcgcaaggggtttggagatgttactacacttactacactttttttgaatacgttgaattttttataatatatatacatacacaagaaagtatatttcttttttattactttatatattataagtgtagtaagtgtagtaatattccgtaaagcgttggggctgttggggtttcgtcactacactttttctaaaaagtgttgtaccaagtgttgtaagtgttgtaacttattttttcttatagcccctctgcgccttccctttaattggcacatataggggtaaatagtggggctggtcatccttggggtagaaacctttgggaaggtctgcccctcttggtaaactaataggataagccaatttttcccagttatcgggtaaatattgcggaaagtgagtatgaaaaccttgactactgaaattatgttgaaaattatgataatctgcaaaacctgtaaagtaccaccatacccaatcattaggaataaaggtagaatgtaaattagtaaatagattttgtgaaaatgctaaaacagggtctatagtttcctggtattcgtctagtaaatctattgacttgctaggctctataaagtccttgaaatctaggtcgataactgtttttaacacgtattctaggacgctagggcgcgtgatataatcgtttttaattgctcggttaggtttccccttaaagtgcttattaaagggtaaaataaccattctacgccgtatagcgtgatagtctccccgtatctttggtagggtgtttgttgattgaatgacaacggtttttataaaagtactatacgcgtcttttccttttttctctaccgttacagtatccccaccaactaggctgaatagtttagaagtatcacgaataaccgcaccagcttgcacatcgtcgcctattatggcttgttttccgattgcttgggctaaggtaaaacgattattaacatctaagtctgttatctttatacttgctatgttctgccgtcctattaggtttataaataactcttgtagcgttccctttcctgttccgccttctcctacaaaccaaaacattttagcgtaactttctccacgtacaacggcattgagtagctgaagtgataactgataaagttctttatccccgttaaataaatctaatagccagccattaaactcccagccctttatagtcgggctttgggcgtgtggattgtagttggtttgtatcttatgagtgaatacccttgtatctgtaaatggttctagtgtccgtgtctttcggttgtagataccattgccaactattatcaaatgtggggcgttttccgcctgtctatgtggtgcttttcgggttaagtggtaaatacaatcgctagcccttttttcgttgtgccgtggctctataatacttataaagtcttttaaaaattccctatcattgatataaattccctcatcagggttataaaaataaacgggttttgttccctcatcgctttcaattctgcaaactgtcagcaattccgccatatattgggcaactatcaaaggtggaacaggctttttaatttctgcttgtgcctgcttatcgtctaacccgtcttctaatagctttctatagcgttcttcctgcttgtgttggacaaattgaaatactttcccttgccaacctttaaacgttctaagccgtatatcacgcgcattatattgcgtttctcctgttatttgtcttccatactgtgtaatactgcccaccttctttctatggtctagcttatgatttttgtatcttgtttttgctgattgataatgtatgctattgtatttcctgtagcttcagcaaaataaaaccgtttcatcacatctaagaaataacttgctaggcttgaccgtttcacaatagcagtaaataagcttactacttgttcaaaatcatagccatgtaaatacatttgtctaataaaaatagccgtttcttcctgggtgtaaattccatttgcgatagtatcaaacacccagccatctaaatataacccgctggcttgtctttgctggtctaacatgtatttctcaatgtcttctagctttgctaatagacttgttttcatgatacttattggataatctctaataagttcccaccctttcggggctggtactttttcaaatactttcaaagtaatattgtttaggctgaaaggtgtgatatatccaccaaatggcaagtagtagaaaaagcggaaaaaattatcttgcattactgcgcgtgtcggattatcttttagtaaatctagtagtatttgttccccacgttttatagtcacttccacaatgctatacatctatttccctttctatgttctttcgtttctctatttgttgtttaacccattcagccctatctttatcatctgacaaagatataaaaatatctatttcctcgcgtgatatttctcccttaagaaaagctattatcacttgataaatttcggggttttcttttctaacggtttctaatatttcttctatatccattcttgaaactcctagttatatctcttgccagcaagccaaatataagccccgtagttatcgtttatatgttgcgtggtatgtttaccctcagaaacttttttaggcttgctaggggcttgaatactgcctaaaccaacgccaaaccatagaaagaggtttagcggtgtaaatattgctatgagtgtgaatgcttgttctattgtcatttcttgcatgttacttacccccttaacttctatacctcggcttctagcaatacttcaagccgtttcttttcttcttcgatttgtttttcaagcgctcctatacctgccattagttcgctatgattggctggtataaaatagcctttatgattgcctttgcggttgccaataattggtattttatgcttgattatcagccgtctaacacattccctaaccgttcttttatctaggttggtttgttgtgctatgtggcgcgccgtgatggctttttcaatccctacaccgattaggctatatatatgcttgtcgtttccttttaagtccattttgacccctttccacattgtattcttgtatttctggtattagctcgcgcggtggcgcgtgctttttccgtgtgttgacctgtctacaatttttctttactatacgtttttttatctagactatccccagcggttgcccgccccaaacttatcttgtaagtgtgtgccaaaataatagcctagctaatgtgtgctttatgattttaaaaatcttaatatcttgaaataaataatattgacttgccttctcattgtccttatggtatgattaaggcaataacaaaggtgtgcaagggttcgcccttccctggttattgtttaatcatttgaaggcttgtcagtttggtcgctggtgtaagccttttttgttgtcattctttcaacttttctagtatttcttctacatctcgcacatcatagtagatagacttcccttgacggcgtgaccttaacccacatgactttaaatatttcatgtatttgtggtcaaagccgtataactccattacttccccttgtcgtaggggctttttgtttagccgttctatttcgtcctttgccatttcacgcgccaaaactaaggcaccgcggacaagttcaaggcttgcgctttcgcttaacaatgcttctgccatttattttttccttcctgttcaatatgccgcctaaaatcgtctatacggcgtttttttattttctggtatctttatactacccgttctaaaaaatcgctagaatgtactttttttgagaatttaaccccctctaggcgtaaacctcataaaattctttgtaaatgtcgtcggggatttccgttagggcttgttgttggagttggatagcctttaggcggtttgtatcgcttgccgttggcttattgataatgtccgccgttgctaaaacttgcttgaaatactcgtctagctttaacttccgcccctcggtaatttcttgtttttcttctcgtttggtttttaagaattgaaattcgtcaatttcatcattcagcaagctataagagataatgccacggtgtcgccattggttaaaacgtgccttaattccctctatcgtccaacctttcagccgttcttggagtaaatcaaagctaactagcccattatcttcataaacctgtaggagtagttcctgtgtaaatggtgttttagtcatttcaaccccctctaaaatccttcccacgtcattagaactatatcttctgtggtgtactgtgtattttttaacgtttcaagttcttccataaccgctttaaagtcttctttgctggttttgggttctaggatttctattgctcgctcgctttcttcattgattttagcccaagcaagtgttaaataggctacattattaggttcaagcgttttttctagttcctttgtaaagttttgtaggctttttgaaatatgtttcatatagaaagcgtaggtggtaaggtggataagttccgcactattaatggttacaatgttatttgtctccatgttgtttacctcgttttttcttgccttttgctcgataatgtagggtgtgttcttctagcatttcttgaatttgtacccatgcttgggcgttttgttccaccatatcgtgtaaaacttcagcattttcatctagccccatagcttccgccatgtttacctggtcatctacccattttttaaactctttataggtttgttttttgctcattttgtattttctccttctaatgttgtaagtaaactatcgattaaggtttcaaatgttccagcaatttcatttaattctttacctagactttttccttctgattctaaggtttcgccaatactataaagtttttctccgtcctcattttttactagttctaaaaatgtgccaactgtttgtttatgctcgttatcctctccataagtgaaaagtactgtatttttgtcaatcatagtcattgtgtcttctcctttaatttctcttgtaaatagccttgtatctcccatatgaaacggctaacggcttcaaatttgcccgctagggtcgtttctatggcttcattattcaaactagctagataatcggtaatatagtctagctcttcatctgacttgttagcacgctctaggagtgcttcaagttgtttacttgccattgtctgcccctgtgtcttttgtatgctcccaaagggctttataatcgccgtcatggtctaggctttctagtaggtaaagtgcttcgtcgccaaaatctgctatatggtctagtgttgtatttactgccatttctgggaagtctgtgtctagtgtactgtccgctatatccattagcattagttctaggcggataaccctttctaggagttctaggcgtgttgcccgttgtcctaaaaaggctctacgctcaatacagtagcgttcttcaagtgtggtcatgttgtatttcctttctagcacgcgcctgcgtgtttattctttggattaggtggggaaacctgtattattgtttaatcatttgtttttgtcgttggtcgtagttttaaggggtacgcccttaaaatggtttttagttctttttctgcgcgtgattgcccttggtcggtggccaatcatgagtaaatagccattgtaagatagctagaatgtgcctagctgtcttttttagggttagataaagtagtccgcctatggtttacctcctttctttgtctgtgtcgttttcctgtagtgtgtgtgaaaggtagttaggaaaattacacatcttctagtagccaatttatgacactttcatagatacggcgcggggcgtcatagttgccctgctctactttggtcaaggtttggggcttaatacctagcttttcagcagttgccttcttcgttagcattaagtccgcacgcttgcgccgtacttttctagcatggtcttccgttagtagcatttatacacctccttccacggtcttaaaagccgttttttgctacacttgagattttaacgcatttaaaaggcgttgtcaagaaaaatacggctttattattcatattttttgtttttatgttataatgtgccatgaaaggtagttaaaatatatgaataagctaaaaactttgagaaaagaaaataatttaacacaagaagagttagccaaaaaaattggggttaacttacgaactcttcaaaaatgggaaaatggagaaagctctatcagaacaaagaatgctgaaaaactagctaaacatttcggcgtaagtgtagggtatttgttggggtatgaggacaaagtaaaaaaagaattctataaacaacttgacttatacaatttagatgaatttagaaagtttagaataaaattaaatattgaattatctctgctaaacggtattttagataatgattatgaaaaaatatctgacaaagtttcttatctaaacaattttgctgataaagaattaaaaagaggtatggaaaatgaatgtttagaacctcaagaattacaagaattatttgagttacgaaatgttgcgagctattttacatctttggtagaaacattagaacaactccaatataatttaaaaaaactgttagaggatacgggaaaagacacataaaaaacgcaaaccccagcaggtcggcgcgtggaataaatcaaaaagaaaggaaaccatgcaacattacagtttagacgaatcaggaagcattactacaaacaatgcccctaataaccgtttttttatcattgctggagtgactgccacaaacaaagataaggtaaaacgggtattcagaaaagccaaagtaaattacctaaaacacaatcccgatgtactactagacatcaaatcagaaataaaaggctctcaaatgtcaatagagtttaaagactacgtttttagtcaacttatttcaaaaacagatatacaattcaattacctggtatttgacaattacaacgccttgccacggctaagagaaaaaccaaacattacttttaattatctgatgttcttaaaagctgataaactcctaaacaatcaaacaccactaaaactagacttggacgatagaaacaagagtgtcgaaagtttaaaagccctcgaagagtatctacaaacaaagttgtgtgtagaaagtgatagggtttcagatgtgaaagttgagttctttaactcagcaaaccatactatgatacaaatagcggatattttcgccaatcatttgtatagaatattcaagcaagtagcaaaaaatcaagattataccgaaaatatggagctacttgccaaactgaaacaaactaacctacaacattgccaatacttcccagctggaaagtgtgaatgtgcagaccttttttagtgataagtagaaaaaagcacgaaaaaacgcaaaaaatgacataaatagttgaatttttcaataaaaagagttatattaattatagaaaaggctacttgtaattctgtttgtgtctgcgtattgtcgtaagctgcctgtgtggtatgccagccaacagttaagggcttttttaattttgtcattacaaaaaggtggaatagtttttattctgccttttattgttattctacgatgttacggaaaaacgccaaccccagcaggtcggcgcgtggaaatatacaaattgattgacatataacctataatgggggtataatcatagtgtaaagaattgttgtgaggacaattctagcactaaatcaaaaaagcccccaacgtgccagcgttgagggtttttgtttgcccctgtttggggttagtcgtcgttatcgtctaaataatacttaactacttcagtcaagatattaaccaataacggcgctagaatacttgtgaggataagttctagcaactaaatcacctcccttcagtaaattcagggggcttgtatatcttatcagataatttattttgttgtcaaattctccccgcttacacatggcaacgtgtaagcaaccacttataaacacgcgcatactattttattctttcgattaggtggggaaaccaataggaaggataaacaaatgattaaccaataccaactaaaagacggctctattagatactcttatattgcttatgtaggtatagatccactaacaggcaaagaaaaacgcgtaagaaaaagaggttttaacactaagaaagaagctaaaatagctgaaagccaattacttctaaaagtggagcaagatggattttttgacaagccagatagaataacctttgaggaagtctataagatatggctggaacactataaaaacaccgtgaaggctagtacatacgccagacaaaaggcgcaagcagacctacatatagtcccagtattcggcgcgtgctacgtggataaaataagcctaccaatgtgccaaaaacaggcacaagaatggtttaagggctacaagaaatatgctaactttatcggtatgactaagatggttttagattttgcggtaaatctgggttatattcatgataaccccatgaagaagataataaagccccgtaaatcctctgaagtcgatgaagaagaaaagaaaaaagaaaacttttacagccgtgaagacttgcaaaagttcctagactgcgtagcaaaggaagacaaggaagaaatagcttgtattttccgcttactcgcctttacaggtatgagaaaaagcgaagttcttgccctacggtggaaagacttagacctctttacctcacgtttatcagttagccaaatagtagcctacggagaaaataacagtatcgtctatcaaacacccaaaacaaaaaagagtaagcgcactatcacgcttgaccctattaccgtgtctattctgaaaaaatgggaaaagactagacaatttttaaacttcccccagcgcgtgaaaccaactgacctagtttttccagcagaaacaggcaacgcccatagttttgattatataaactataatctgcgttgtattctgaaaaaatatgacttgccttatataacgccccacggtttccgccatactcattgcagtttattatttgaagccggggcatcgattaaggaagtacaagaaagactagggcatgaagatattaaaacaactatgaatatttacgctcacgttacggaaaatacaaaagaaaaaacggctgaaaagtttgcccaatttttgggaatgtaacgcccagccgttaccatttccgttaccatttcaaaaagaaaaccattcccacggcacgggaatggcttaaaatcaacgtttctaacggttttataacgctgattatttgagaccgtattttttgttgaagcgatccacacgtccatctgcttgagtgaacttttgacgtccagtatagaatgggtgtgagtctgatgaaatttccacacggatcaatgggtaagtttcaccttcgaattcaactgtttcgttagatttcttagttgaaccgctaaggaacttgtagccagtagttgtgtccatgaagacaacagtgcgatattctggatggatatcttttttcattttaaaattcctttctgccatggactctttccgagccatagattataaccatttaagtttaccaaaactttgttcttatggcaagtctttttacctatttttttaatattttttcaagttatagtacagaagcacctgaagcaaggtcagaagttactctggcgccaaatccccctcttgaaggactgcccaagctatcagaaattctttcttcaccagcaagaactttctcagaaagccctgaggtcactagaatcctgccatccagcccaatcagaaccgcttcgataccatcagtttcttctaccatcttataaatccgagttatttcttgaccaaacagtcgagtcgtccaaatctcaccatcaacagattgtttggacacaatggtcaaactagccagctgcgactccattggatagccggtctcaggactcaaaatatgatgataggtctttccattcacggtaagggttctttcgtaaataccagaggtgacaaccgattcttctcctattttgaggacgagggcattttcaccacgtggtttctgaggatcctgtataccaattcgccaataaccatctgcattgtgaggagcttgaccaaaggtcaggacgttgccacccagattaatcagcccagctgccacacctattcttttcaagaagtcaacaatcttatctgctacatatcctttagcaagagcacccagatcaatcgccataccttcttttttcaaatagactgtctgctcctcatcatctaattcgatgtcccttggattgatgagctggagtttttcactgatcatttcttgggttggaagtttggcatcgctaaatccaatccgccaactttgcacaaggggaccgatggtaatattcaaaaaagatccctcagccagactgtgttctttgcccaattttatcaattcatacaggtcatcggcaactggaactgcttgaacaccagcgtttagattgacctccatcaattctgaagtcaaatcattggcagaaaaccggtctttataaagataaagtagctcttcgacctgatctaaaattggttctgcatctggatgccatattttcgtttcaatgatggttcccattagacgaagggaacggctacttgcttgcattcctcactacctcttggatttcttggtatatttgctcattttcggatagtgaataagagttagcaccacttgctagtgggtggccaccgccatcatggcgtttggcaatctcgttgattggaagatacttactgcgcaaacggactctgtaatttccgtcagtttgttccacaaaaatcccccaagattgaacgattccaatccgtcctggagccccaacgataaaggaagtgtccgcatcggtcaccccgtatttttcgagaatgtcctgtgtcaaaataacacgcgccgcaccatgttcatccacttccaagttgtcgtagacgtaacctgtcaacttggcaatcttgaaatcaatggtatccatctggcgagacatccttgcaaagtcaaaatcttcttggcggagacgagcaacaatctcaaaggtgcgcgagctggttgccggatagagaaagcggcctgtatcgcccacaattcctgcatagagtagacgagcaatctctccatcgagttccagttggcattggatggctagttctgtaatcatttcactgcaagaactagcttccgtattgacccagagcaggtcaccataaggctcttcattggggtgatgatcgattttaatcaagaaatctccttgagcatagcggtcgtcatccacacgcgccgtattggcagtgtctgtcacgataaccaaagctccttgataatcttggtctgcaacttcatccattcctgccatccaagcaagatttggttcctcaaaaccggttaccttgatggtttttccaggaaaactcttctgtaagagtttctgcaagccaacttgactaccaatggcatccggatctggtcgtttatgtcggtgaataataatcgtgtcgtattcgtgaattttttcaataattttactgtaaattgtcatagcaactccttttcatcattttagcataaacttccccttttgaaaatgatgggagtgtggtataatggaattactatgtaatttggaggaaattatggcactagcaaaaatagtttacgctagtatgactggtaacacagaagaaattgctgacatcgtcgccagtaagctagaagagttaggtttggaagtacaggttcacgaatgtacgactattgaaaccgaagaaatcttggatgcggacctcatcgtggtagccagctacacctattcttacggtggagacggtgagcttccagatgaaattgttgatttctatgctgacctagctgacttagatttgaccggtaaggtctacggtgtttgtggttctggcgataccttctatgatgacttctgtagtgcagtagacgacttcgatgtcatgttgggttcacgtggtgcaactaagggtgccgaaaatgttaaggtagatcttgccgctgaagatgaggatattgttaaccttgagcaattcgcgacagaccttgttgctaaactagatacaatgaattaactgacaaacagactggcttatcaataggtctagtctgttttcttttagccttttattaagattgtacacctattgcttgcaatcttaatagttttgatatataattaactggttaatttttttgaaaaaaggagaattttatggctaaaaaatcaaaaatggcacgctatcagagacaattggagttaatcgagcgctatgcggatttacgtaaaagtctcaaagaaaaaggtgactatcaagcacttcgaaaattgcctcgcgactcaaatccaaatcgactgaaataccgcgacaggaccgatggccgtccgcatgcttatatgcgaaaattcggtgtgagtcggattaccttccgtgaattagcccatcttggtcaacttcctggggtaaaaaaagcaagttggtaacttcctcaaacaaggctagtattctgccttgttttttgctatactaaaaaacaactgaaacaatatacggaggtttataagatgaatttggattgcatccgcgaacagattaacacgattgatagccaattggttgaactacttgaaaaacgaatggagttggtcgaccaagttacagcctataaacgagcaacaggtaagcctgttttggataccagccgagaaaatgctgtccttgaaagagtcggaaaattagttcaaaaggatgattaccgctctgccattcaagcaacctttagcgatattatggcccaatcaagaacctatcaatcttccaaattagcgaatcatgagcaataagatgaaacatgccatccaactccttttcttttccagcttaattggagtcggtgcaggaataatcaccacactttttgggaaaattctactagggattggagacttacggtctgaatattttacatatctaatcccctttctgccacttgcaggtgtgttgattgttttcatttatcaaaaatgggggagggaagtccaagcaggtatgggcttagtcttcaaagctggacaaggggagaaagcgcaaatttctccagttctcattccactcatcatctctacaacttggctcagtcaccttgtcggtgcttccgttggtcgcgaaggtgtagctgtccaacttggagccagtctctcacactggttacaaaaacatggtttcacacacttgcccaaagatatgataacaaagattggtatggccgcaggttttgcagggttatttcaaacaccatgggctgctggtttctttgccattgaagttttaatcgttggccaatattcttggactagtctcccctattgtctagttgccgctttcacggcttctactacttcccatttactgggattggagaaattttcgcataccatcgctactacctcattctattttacagatagttttaaatggctatttattgccctttgcttcggtttcatcggcaatttatttgctttgtttctggcgcaagcaaaaagcatctcaactcgatggcttccaaatccttacattaaaatagctatcatgggagttggactgaccgttctactatttttcttccatcaaggtcgttatactggtctaggaaccaatttgatcgatgccagtttagctggggaacaggtgtttgctttcgattggctactaaaactcctactaacctgtctttgtttggctgcaggttttcaagggggcgaagttactccgctctttgcgattggggcaagttctggggctgttttagcaggattactaggtctaccaactgaacttgttgcagcccttgggtattgtgccgtatttggaacagccaccaataccttactggctcctctcttcattagttatgaagtcttcggcgctaatatcctgccctatgctattcctgtacttgccatagcttatcttataaacagaaaacagactatttatggacagcagttgaggaaattcaataatgcaaaaaagcctatcatctaggctttttcgtatactcttcatctcccctgcaggaatcgaacctgcaactaattcttaggaggaatttgttatatccatttaactaagggaagtctgcttctctattgtaccccagaagagagcagattgcaagagcaaggttatataagttttttcaaatctttacaaaaagcagaacctactctaagatgaaacacaattgtttttatgtatttctctcataatagtctctaaaagaagtaattctaaaatgtacttcgaaagtttgtcgtttttatgcttgattcctactccccttccttacgtctcactgagacagccattccgagtgaaactaagccacccaagctaataagaagtgagcctagggcttcttgaccggtatttggaagtgtttgatttcctgatgctttttcagttttcttatttgaaataggagccatacttccagatggtgccggttgctcggttgctttctgatttgttacactatcgccaccgtcatttgctttctcaggtgttttcacatcagtagttgtcccagcattatcttctttttcttctgcttttggttcttctacgtacttctctacaaatgcttttctacctggaattgttgcactaatggtttgacctgctttttctaaatcagtcaagtactccacaaatacttctgtatctggattgatagcaccaatcagtttagcttctttgaaaatcgagaagccatccccaccaccaaataagaagtcgttgatgacaagtgtataggtttctgtcggaacaatctccgtcccatcttctttgaaggctttaacaaccttataaggattttcttccgttggattgtcagccttcgtgtagatatatttaattccagacatttgaaggaaatatttttcaccttcatcatattgttgatttaaggctgtataaatctgctcacctgtcatttgaacgacttgtaggatattcccaaatggttgaacagcttgtgctgctccccaagtaactgttccatcttcttggaccttcaaatctgcccgaatcccgccatcgtttgtcattgcaaagtcaacatcataacccgatttcttagcgatagctaattgagccgatgttactagattacctacagcactttctttaaattcattcacttcgcgtgaaatatctgtcgcttgactagctgtagcaattttttgctcagttacttttttaacaatggtatttgcctcatctacaattgcctgaatttccggacttggtgttttctgccctggtgctactgcaataattttcgcagtcggaacagctttaaagtcggcaatatctgtatcataaacagccctaacatctgcgtaagccttaccttgtgaggtagcttgaacaatcaaggttttgcccgttgtaccgtttgtatagacatggttatggccagcaaatacaaggtcaactgagtgttcaggatagatttcatttagcttagcaatcatatctgcagcttcaccagcagccacaccatccttgcttgtagccggaacgtgagccagtacaactatcgcatttacacctttttcagctaattcacgcgcatatttagcaatcgtctctgcctcattcaaaaaagtgtactgctcatagtttttcttcaaaacaagattaggaatttctgtcgtaactacaccaataaagccaatcttagcttctttatcattcacgggaatagtcttaatagcgtagggcttccaaccatacggaatttcacctgtttctttgtcaataacgttagcaataacaatctcctgtttagcagcttcacgagtataattatctacaatctcattaaactgacctttttttggagcttcaccagtcatgatacggttatactcatcaagtccctcatcaaactcatggttccccaaagttccgtattcaacatccattttattaaagacttttacagttggttcatcttgcaaaagtccagaattcgatggacttgcaccaaccatatccccagcttgaacacggatagactctgcaggtgtctctgtttctgctgctgtttcttcaaattctgcttgtgaatcatccatgtaagcatcaagtaaagcggcagttcctgcattacgaactgtttccccttccaatcgcgctgtccccgtcatatcaagcgcaccatggaaatcattaactcccataatttggacagctaattcatctgctaaaacagcttgtgttgcaataacgctaaaaccagctacaagagctagtatactgcttttcaaccgaatattctttttcataagcaaaacaatgctccttctatttttttcatattgacatatctataataatccttttcttacggcttttcaatatcaaatcagtcatttataacaaaaaattataaaaatattcgtttattcttacttttacatcatttttctgaaaatatcttgtcatttttatctataatacgaaaattccccttcttcccttacacaattctctccaaaatactcctcacaactaaaaaatctcttccaaacggaagagaactgttcttatttagctgctttataaagttcgttaaccttgtcccagttgattacttcaaagaaggctttgatgtagtttggacggacattgcggtagttaaggtagtaagcatgttcccaaacgtccaatgccaagattggtttcaaaccttgcatgattggtgtgtcttggttagcagttgagataacttccaacttgccttctttattaacaaccaagaaagcccaacctgaaccgaaacgagttgttgctgctgcagtgaaggcttctttgaaagcatcaaatgaaccaaaggttgcatcaatatctgctgccaattctgctgaaatttctgttttttcaggtgaaagcaattcccagaaaagagcatggttcaaatgaccaccaccgttgttgatcaaagcttggcggatgtctgaaggaatttgctccacatctgacaaaagagctaccaagtcttcgccaatttcaggatgtttttcaagtgctgcattagcatttgcaacataagtcgcatggtgcttatcgtggtgaagggtcattgtttctgcatcaatatgtggttccaaggcatcgtatgcgtatggaaggtctggtaaaataattgtcattttcgttttctcctatactaagtgatagttctattctactccaatgtgagagccttttcaatttatttgtctgaaaccacggttgaccctcaatctaagaatactctttttactatgtagtcgcgatttttaataatagcaaatcaaataaataatccttatcaaattggccggttttaatttgaaaatctgtatcgattaggagcttgacgacttttttcaaaaatccaatggacagatggcgtgaatcacgcaaagcatactttacttggtatggattcaccttacgccccataatagttgataactcagctactatctgctgttcccctcggccttgctctagtagtatttgcacttgtagataggttcgaaattgggttaacatgatggcaatcaacttaacctcttcctccccttgcaaccgcaagtcacaaactaagttgcgagcatcgtctaccttggattgtagaattaactgtgttaaatcaaagatattatcttgtagtgtttttgggatagccgcatcaatatctgaaatttcaatcgtctcttttcccttataagattgaagaaaggctaggttcttactgatttctgcaaaatcaaaattggacttttctaaaagatattgaaaaacctctcctcccatctgcaatccaagacgcattatctccttttggaaatgatttttcaaatccatctccttcagaggattggcttctaatactagtccatctcgtttgaggagtttgaccagacggcgcttactgtccaacttacccggtgctagaatgaccaaacgtgttgtttcgacaggattttccaaataggcctcaaactgtttgagttcatcatctgtcaaatgccgttttttatctgtcgttaaatctgcaaaataatcaagaatcactactttttcatctgaaaagaagggaagagaaactaggtccaagtctacctgatgataatcagcctccgacatatcaaaataggcaaaacctaaatctgccgcatcaaaatgaagcttccgcagaagtaagtctttcgctatttggtattgtccgatgtcttcaccgcataaaacggtcagaagctctaatttctctttttttaatttttcaatctgttcaattactgtcataaaaacctcaaaattcttttctcattgtaccacaaaaagagcctagacataaagtctggactctttcattgaaatttatatcaggaaggtaggaaaaaattaattgataatcactccaaatgacctatttcccaaatagcagttcctttgttagctattccaccatcctttgaaattccaccaagtatcttgaaaagtatcctttatccgatctctccaagtcttattttcttcttcctcaatagaacgtttgaacaaggcatctgcgtactcatcctcttgttccttttgattctgttcaactcgtttcttttcgcttttatatactaattgaccaaaatacaaattcccatcgtctgcaaattttaatgtaacaacatcaccttcttcgagtttcttattcaattttacaacataatctccactgccgtccgcacgttccccacttgtataccactctctagtttggcaattctctgtagtataactcggacacttgagttcatgctttacaggctcgaccttcaatcgttctccatttatatatgtagcgacataaccaaatgagccaacatggacatgaatagagtctgaaccagttctaaaaggagctacttttacccccggaacattctgttgacctactggtacaaatattgaagtctccgcctttacacttgataacgatagtaaaccgatgacaaaggtaactaaaataaatgatacttttctcaatttcattttgcttttctcctagtagtacaatacattaaccggaattagtatataccaatttcatagagaaagcaagaaaaaacgctccttaagtaaaaactaaactcaaaaactcaattcttatccagcaccttgaaaggaatgtgggaataatctctgtgcgtttttaaaaattccaaggcttctttttttacctgtatgagattaacaccttgggcattggctccatagacacagccacaatagcactggcgataaatgtcatactcttcacacatttgaactgaacgctgatagcctccatttttcttaaagtcactcggaagatactgggtatcgtataatttctgcacctcaatcccaacagcattgatggtctgcgaattcttatgtggactgattgtcaaagccgaaccaaaatagtcaaaaccaagctcaactgccttctccgcagtcttatccaaccgataatcatagcaaaccttacaccgatctcctccctctggctcattggcgagatgctgagttttcttgaaaaattcctgagggctatagtcagcttctaggtagcctactgactgtccagttttctgattaaattctttgacaaactgggccgtcacggctgcccgccgctggtactccgcctttggatgaatattggaattcgcaaaatagatggttacatctgcatattgagtcaagtactccaatgtataggtcgagcatggggcacaacagacatgcatgagaatgttcggtcgaagccccgcttcctgccacgtgcttgccattttttgaaacactttatcatagttaaccttttgattcggtgatagagtcgataaaatctcttcaactttaatcatacaaacctccaaatatacattcattatactatatttgaagcctactgcatagatagtaataacgagggagagcgcttgataaggatccctatttccaacttaaaaaggtccctcggaccttgatataaagaaaaacgcctgccgacgtttctcatctccagcttaaaacgtggggtaacccacttgtaaagaaaaccgcttaccagcggttctcatttccaacctaaaacaacccgtcaggttggggacaaaccagcaacatgcattgctggttttcctatctcccgattaaaacagcctatccgaatataaaaaaactgcctgccggcagttctcattttcaacttaaaacgtggggtaacccacttataaagaaaaccgcttaccagcggttctcatttccaacctaaaaaggtcccccggacctttttagccacccagatatgcttttttgacttcttctgaggcgaggagttcttttcctgttcctgagaggacaacttttcctgtttctagaacatagccacgatcggcaatagcgagagctttgttggcattttgctcaatcaagaggacagttgttccttgtttttgaatatcttggatgatatcaaaaatttcttggataaagatcggagccaagcccattgatggttcatcaaggagcaagagctttggttggctcattagggcacgtcccatggccaacatctgttgctccccacctgaaagggtagctgcatcctggtttttacgttcttccaaacgtggaaaacgagcaaagatttttctcaagtttgcttggttttcttcacgattgttgtgaaggaaggcacccatttccaagttttccataacagtcaagcctgcaaaaacatgacgaccttctggaacttgtgataaaccgtccgccacgattttacgagcaggaactttttgaatctcatttccaaggaaagaaatcgttccagctgatggacgaacaagccctgaaatagtacgaaggatagaggttttaccagcaccattagcgccgataagggttacaacttcaccttcattaacctcaaagctaacatctttaacagcttcgataacaccgtagttaacggaaagattttttacttctaacattgccattaagcttcacctccaaggtaggcttcaattacacgcttgttattacgaatttcttctggtgtaccatgggcaatcaaacgaccgtactccaatacgtatatccgctccgtcacttccataaccaagctcatatcgtgttcaatcaagatgatagtaatgccaaattcttctttgattttacggatgagttgggtcaattctgccgtttcttgtgggttcataccagccgctggctcatccaagaaaagaattttcggttcagtcgcaagggcacgaacgatttccaaacgtcgttgttgaccgtaaggaaggtttttagctaatgtatctgcatctccatccaaatcgaagattttcaaaagttcaatcgcttttgttttcaacgcttcttcattcttatagaatgctggaagacggaagaaacttgcaaatacttctgatttaccatggttgccaagaccaatcaaaacattttccaaaacggtcatatttttgaacaaacgaatgttctggaaagtacgacctagaccaagcgaagcaatttttgatggtgctttaccgttcaaaatagtccctgccagagaaattgtcccctcgcttggctcataaacacctgttaagaggttgaaaagagtcgttttaccagcaccgtttggaccgataagaccaaccaattccccttcatgaagttccatggtcacgtcaccaacggcagtcaggccaccgaagttcttggttaaatcttttacttcaagtaatgccattacttaacctccttcttcttgagtagagccgctacgctgaattccttagttcccaaaagacctccaggacggaaaatcatcaagagaataagagctaatgaatagataatcattgaaatatcagagtaactcttgaggaatacgttcaaaataccaagtacaatggctgctacaaaggtacctgtgatagagcccaaaccacccaatacaatgataatcaaaacgttaacagaggtcataaaggcaaagtctttcggaacaattgtcccaacgtatcctgcatggagaccacctgcaatggctgccgtcatggcaccaaatacaaaggctgaaaccttaacaaatgttggattgacacctacagattctgccgcaatttcatcctcacgaacagaaattgtagcacgtcccatcggactgcgcaaaaagttaactgtcaccaaggttgtgatgattacaaaaatataaactaaaggccagcttgtaaagagtggtatagacataatacctgctgcaccattcgttacactaccaccattgataattaaaatacgaataatctctgcaacaccaagagtcgcaattgcaaggtagtcacctttcaaacgaagggttggaataccgactaaaagagctactgcacctgagattaacatcccaacaatcaaggcgatagcaaatccaccataagtcggcatcattttcccaagaatacctactgcataagcaccaatagccataaaaccagcatgaccaagtgaaaattgacctgagaaaccgacaatcaagtttaaaccaactgccaagataatttgaataccgatttgctgaacaatctggatgtagtaaaaattcagaatccctgctgatacaagaccttgaataagtccaaaaccagccaataagatagccaaccaaatcgcattaacttttaaattttgcttcatggttacaccttctctttcacatttttaccaagaataccacttggacgcaccaagaggatgatgatcaaaacagtatatacgatcgcatcgcggaaagtatcgaattcaatcacataggtgaatgtttcgatgataccgataacgaagccaccaagcgctgcacctggaataataccgataccgcccaatactgccgcaacaaaggctttcagacctggcgtcatccccatcaaaggctcaatctggttgtagtagagacctaggagaacacccgcagcacccgcaagagctgacccaagagcaaaagtaaagctgattgtacggtttacattgatccccataagctgagctgcatcgctatctacagagaccgcacgcatggctttccccatttttgtacgtttgacaattaattgaagtgcaaccatcaacgcaagcgatacaccaagaataatcaactggatattcgtaacagaaactggaccaaggttaaaagtcacagcttcgattgcttgtggaaaggcttttacgtctgctgtaaagaatttaatcatagtgtattctaagaagaaggatacaccgatagccgtaatcaaagctgctatacgcgttgaattacgcaaaggacgataggctaaaaactctataactacaccgagaatagccgtccctaccatcgctagaatgagagcaacaaagaaacgcgttccaccatctgcaataaaagttaaattatttaataggaagtaccccataaaagcacccatcatatacaaatcaccatgggcgaagttaatgagtttgataattccgtacaccatggtataaccaagggccaaaagggcataaacagaaccaagaatcaaaccattgacaagttgttgaagcataggttcaccaatctttctaaatatttttcgagctcaatagcattgttacattatacaaaattttctgaaaataagcaagttagacagagagtttaatcattaaaattacagaaaatttaaccaacccaaatttaaccaaattttatatccgcatgtatactattctatacattctgacaagtgaaaaagagggaattccctcttttcatccactattagtcaatagagatagtatctacagatgattcttctccgtttgttaaactaacaacataaactgatttaatgacattgtgctctttgtcaacagacattgtaccagtcacacctttaaagtctttcagagctgcaagattagccttcactgctgctgaatcagctgcaccttttgctgcttctgctgccatgtaaaccgagtcgtaagctaaagctgagaacattgatggctcttcattgtattctttcacataggcatcatagaatgcttttgctttttcgcttgctgatgttacaaatccagaaaggtagtaaacatttgatgctgctgatgcagttgccaattcagtaaattgtggtgagtcaaaaccatctgaaccaagaattggcttgtcaatacccaaaccgcgtgcttgcttcacaattgtacctgtttcattgtagtaaccaggcatgatgatcgcatcaaattccttatctttcaattttgtcaaagcagcttggaaatctttatcgccagaagcaaatgtgatttctgaaacgatttctcctgtgtatgctttcttgaacgcctctgctacacccttaccataatcagaagagttgtcaaagtaaagaacaactttcttagctgacaagttctcagtagcgtatttagccataatttgaccttgatacccatctgtaaaggttgtacggaagaagtattcttggacctcacctttatcgttcacaaccaaggttgtttgagttcctgaaggagtaatcataggaacaccagcagatgtcaatgctggaatagaggctgctgaagctcctgatgtagcagggccaatcacaacgtttgccccttcacttgccaagcttgttgcaacagtagctgcctctgctgtttcagacttgttgtcttttgtgatcacttcgatttttttgccgtcaataccacctgcagcattgatttctttcacggcaaggttggcacctttttcctctgtttgaccataagatgaaacagcacctgacaactccaagttgtagccgattttaaatgtatcacctacagaagaacctgcggctgaagtattggttgtcgaaacattaccacatgcagcgagtagagctgcagaggcaaatgtagcaagcgctactgcaaattttcttgttttcatgaaaactccttaaatctttcttaaattttacgatgtatctaatatactgaattatctgaaaattgtcaacaaaaaagaaaaaaattttaaaataaaaaattagcagggaatacatacctgctaattccgactatcctacgactgatggttcttcatctctccatagattacctacaaagttttggtctaattccttaatgtatgaaggaaccactttttttacaaaacgttcctttttcaattttaatatggtagcttctactagttcttgatccatatacaccaaaacatatcgcaagcgtttggaatggtaaacaatatctccatattggctgagtttacgtgcatcacgattgtagtgtaaatagacagttaagcaagtgcgatttttcttctcaaacatgtcttctcctctaaaaattctctttctatattataccgttttcaatgataaatgaaaagctccaactacctgtaaaagagttggagctaataggaatagtcagtactattacatatttgtcactgcttatttgacttttgtattgtccataatctggtcaataaatccgtaagccaaggtttcttcagctgacatccagtaatcacgttccgcatccttgtggatttgcttgactgtcttacctgagttgtctgccaagattttttctagcttattacgtgtttttaataggtgttctgcagcaatagccatatctgtttgctgagtaccaccaccagttccacccattggctggtgaatcatgtactctgcatttggcaacatgaaacgtttgcccttggcaccgcttgatgcaatgatggttcccatgctcgcagctgttcccataacgatggtttgaacatcagctttaatgaaattcatcgtgtctacaatggcaagacctgctgacaccgatcctcctggcgtattaacatagaggtaaatatcctttgtagggtcttgggcatcaaggaaaagcaattgtgcaatgatagagtttgccatgttgtcctcaactggtcctgtcaacatgataatacggtctttcaaaaggcgtgagtaaatatcataagaacgctcaccacggctagtttgttcaataactactggaatcataaaattactccttttcgagattttctgtacccattatatataaatagtcaaaattggtcaaataaaaaacacgatttcaggaaatgaaaaagaaaccagcagagctgatttcttaattattttgtaccgaacaagcggtcacctgcatctcccaaacctggtacgatgtagcctttttcattgagtttttcatccaaagctgctgtataaatatcaatgtctggatgtgcatcttgaagagcttttacaccttctggagctgaaacaagagcaacaaatttgatatttgaagcaccacgttttttcaatgaatcaactgcaagaatagctgaaccacctgtagcaagcattggatcaactacaaaaatatgacgttgatcaatgtcttctggtaatttcacaagatactcaacgggttgaagggtttcttcatcgcggtacataccgatgtgaccaactttagctgctggtaccaagcttagcaaaccatcaaccataccaacacctgcacgaagaattggtacgatagctaattttttacctgcaatttgtttctgaactgttttagtgattggcgtttcaatctccacatcttcaagtggcaagtcacgcaaaacttcgtaacccatcagcatcgcgatttcattaaccaactcacgaaaatcctttgttgaagtagatgtacgacgaaggatagacaacttatgctgaatgagtgggtgtgaaatgacttggaatttccccatgatgataaaacctctcttttttgttttttctattttaccaaaaaaattgaaaaaatgcttgagaatatggcaaatttatttattttttgaaaacgatagcttcaaaaggtctcaacatccctttattaatcgcctcttcgttttcataattgttcatgaaaatagaatattcttccacagctatagtataagcctgttcctggcttgaaaagtttaccaatatgatgaaatcatcctgttcatcatatttacggtaggccattaccgagctatttccagtctccatcacttcatattttccttcagacatacaaggatactctttccgaagagcaattaatttttgataggtataaaaaagtgattgtttgtctgcaagtgctttttcaacattgatgtctttgacagtatctcccaaagccagccaggcttgacctgtactgaagcctgctccttctgcctctgtccattgcattggacgacgagcattatctcgacctttggcatttatagaagtaatcaattcctccttggtgaagccattttcaatccgttccgcatacatgcgacgtgtttcaatatcgtccgcttggctaatatctgtaattggcgtattaatcataccaatttcctcaccttggtagatataaggtgtccctgacataaaatgaagatagatagccaacattttaccacttagttcacgaaatgcaggtcgatcatcaccgaagcgagaaatggcacgaggtaaatcgtggttattccagaaaagcgagttccagcctttaccaaccagttcagtctgccatttggagagaaccttatgcaaacgtgctggatcaagcggtgccaaatcccacttttctttcccttcctgctgatcaagtccgacatgttcaaattggaaaatcatcgaaaattcttttctgtcagggtgtgaatataactgagcattttctggattggcactccatgtctccccaacagtcactaagtcgtaagcaccaaaggttttctcgtttaattcctgaataagagggtggagagtcggtccatcggctgtaattaatttttctggttcttttccaatcaaatcaatcacatctagcctgaaaccgccgacacctttttcaatccaaaaattaatcatatcccagatttcttgtttcagagcaggatttttccagttcagatctggttgcttaacagagaattggtggaggtagtatttgttcagatgtggaacgtattcccaagcagaacctgagaaggtcgagcgtaattcattcggctcatcagcccaaacataataatcataatagggattatctggtcctttgagggcttcttgaaaccagaaatgttcatccgaggtatgattgagcaccaaatccatgattattttgatattgcgcttatggccttctgcaatcagctcttccatatcttccatggtcccaaattctggagcaattccttggtaattactgatgtcgtaaccattgtcatccatgggggactgataaacaggactgagccaaatagcatcaattccaagctcatggagataatctaatcggctgataatccctcgaatatcccctactccatctccatttgaatcttgaaaactacgagggtaaatttggtaaatgacggacttcttccaccaatccgtcttttgtatttctgacatttgattgatcctttctgcacaatcttatttagtcaagaaaaagaggtatctcccctctttctatataatcatattataactcaattatggtaatttttccctcttcaatttcaacaatttcaaaggatttttcttttaggtttgctgttagacgggcagacacccctgcatcttgattattccagaaaatttccatacttgtttcatccagcatcttaacagagaactctccgtcgaaagctggacttgtattgcggaatttaaggagtttgaacaaggattgtacaactggccgttgcacttcctgctcaatttcttccaaatcatagtaatggcgattgatattgcgcccttccttacttgattctaaaagttcaatatcattttcgcctgcaagtaaaccaacatagtaaatctgtggaatacctggtgcaaaacattggagaacacgcgctaataggtaagcttggtcgttattgccaagagcagaataataagtacagttaatctgataaatatccaaattattataggcttctgtactataaattttcttcacattggcaccttgtgcatacaaggcttcacgcgtttcctctgtctcctcatccgtcagcaaatccttaacatccacaacaccgattccatcatgtgtatcaagagttgtaaattgcttgcgagggcaaatctccatccagtgaaccaggcgattgacatgaccagaatacaaagcgtggagaactagcattggcaaggcaaaatcataaacataataatcttgctcggcaattttctgctgaatggtgtagtgttcatgaatttctggtaagatttctacatcttttggtgccaataactgacgtggaaaatggagcatttcccaaatatcaggctccacaaagaaacaattggttccgatttttttattggcataagcaaaggcgtccaaacgaataatcgaagcaccatgctctgccaactgttccaaattttcttggatgaaacgacgggttgtctccgttgtcacatctaaatcaatctgctgttcatcaaaggtacaccacaccttctcttcactaccatcagcaaatgttgcaattcgatatggagcacgaggtttacgcttatagatcaaatcaacatcttcttgcgttggctcaccatttggccaaaagtttttatagcgaataaacaaatccgcataagctgattcatctttcttttcaagaaaatcaaggaaataaggagattttgcagaaatatgattgatcataaaatcgaacatcagataatagtccttgctcaatgcttcaatatctgaccaatctccaaatgcagggtccacctttgtataatccattggcgcaaacccacggtcacctgatgatgggaaaaacggcagaatatggatacctcccacaacatcctttaatggaccttcgaggacttttttcaaatctttaagattcttgcctaaactatccgaataggtaatcaacatagcttggtttttaattttcatagactttctcctttgtaagccttttcttttttcattgttagaaaaggttgaacaagtcaacctttgtaattatttgacagaaccacttgtcatatctgaaataatatgtttttggaagatgaggtaaacaagtaagattgggataatccccaccacataggaagcaaatgatggaccatagtcactaaaatacataccttggtaattgtattggaaaagaggtaaagtccacatgctttgatcacggttcaatactagtaaaggcaagaggaaatcgttccagacccagagggcattgataatcaaaacggttgcatgcataggtttcatgagtgggaaaatgattttccagtacatagtaaatttatcacagccatcaatagctgcagcctcatccatttcttcaggaacaatggtcttaatataaccgacgtagaggaagagggcctgaggaactgcataggtcaaatatagaataatcaaaccgacaatattgttcaaaccaaggcttgacattaatttggtcattgggagcataatcacttggaaaggtacaaaaatcccaataatcaagaaaaagtagataaagttaaacactgtctgacgtttcatttgacgggctacggcgaaagctgccattggaataacaagtagaatcaagccaacagctacaatcgtaatcaaggcagaattgccaaaatattgtacaattccatcattaaacaagcgttcgtagttatttaaggtgaaattttcaggaagaccaaagaagttgctcgtaatttccttggttggtttgaatgagctaataatcgttacaagtagcggaataaacatgaagagaataccgctgaagagcacgagatagacccaccaatttttctgtttttgagtattcatgcctgtcctcctagatttcaaatttcttcgaaattctcatctgaattaatgagatgacaataatgaagatgaagagtactacagccaaagcattggcataagagaatttattgtctacaaaggcatagttgtaaacgagtaaacccaaggattctgttttgccgtctggaccaccacttgtcagtgcaaagataaggtcaaatgctgtcaaacctgatttcatagccaaaatgaaaaccatactgatagatggtaataagaatggaagctcaatgttgaagaactgttgagaacgacttgcaccatcaatagctgctgcttccttcacatcttctggaatactttgcaagccagacaagaagatgatgactggcatcgccagcccttgccagagagccacaaaaagtacagctggaataacagtattttcttgtaccaataagttttccatcaaccaatcgatataaaggatttctccaatctgtgtaaaaccatagttgaacaattggacaaaaatcaatcctaaagtaacagttgaaagaaccgcagggaagaaataccatgttctaaagaaaccaacagctttaatcttacgattgaggagactagccaaccaaatccctataacaatttctccgatgaccaaaccaatggtgaagataatggtaaaagtcatggaagtgtaaaaatcaggattttttaaaatatctaagtaattctgaataccgattagtttgaaatcagatgtcaatccattccaatccgtcaagctataatagatacctgtaaatagaggatagaagaaaaagattaactgtaagccaattggtatggcaacaaatagatagggccaatatttggcaataaatcctttttgattcatcatggtactcctttttgataaagttatagttgcttagtctcagttcaaggaatcccatagggttactaaaactgacactaggcaactataaggaggctaggctacaactagcccctgcttatagttttcctggattattttttcattggatcaaagaatgcgttcagttttttcactaattctgctgagtttggattttttaccatttcaacagtgatattccagaactcttcttctgattcccattcagattgcaaccaaactacgtgtttgtcagtaaaggcatattgtgtaactccagcagtttcttcaaacttaccttctgtatctacaccttcaactgaagttggtgagccatctacatcatagtatttctggataacttctggacgagagaggtattctaggaattttttagactcttctgggtgctctgtatctgctgaaatagatagagcaaggtcagctgcaccgatggtatagtcgccactttctttatcgccagggaatgtaaacataccatattcaaattctggttcttgttggtttacagctgtagctgcccatgtaccttgtggaagcatgagagcatcacctgctgcaaaggctgccaccgcatctgcatagagcgcgcctgttgcccctttttgtccattgtctttcaacaattgcaagcgttctaacactgcttttgttgtagcatcatcttgaatcgctccctttgcactacgaatcagaatatcttctgcaccatcaaatccacccgcaacagttacccaagctaactgatggtagccgttcaatgaccaagcatcgttcaatgaaagagcaaacggtgctgcactgccatcagacttgattttgtctaccaaagccacaaattctgcataggtagttggaacttcgagccccaattctttgaacttatccttattatagtaaataccataggcattagctgtcaaaggaagggtataatttttttcgttaacaagatatggtgttacagcaccatctttcaaatgatttaatcctgcatcatcaccaatttctaggaaacgaccatccgctgcgtatgctttgaagtccgcattttgtggataaatgttgatgacatctggcgcttcgttatttgccatacgggttttcagaacagttcctgcatctggtacatttgaaaatttaacatcaatcgtaggattttccttttcgaaatcatcaataatttcctgaagggtagcttgcatttctggtttttgtgaaaaatattctatttctaccttatcgctactacttgcattcccacaagcaaccaaaaagctggcaaaagcacaaaccgatgcacattttaaaaatgttttcattttcattataaaatcctcctagattttgttaaaaatatattgtacactaaaataatctttttgaacatgtggcattgtaagaccaatgttcatcagttcatccccgtagaatgtctctcctaattgtgggcattcatacaaggcatctgggtctaaccccttcaaccgaacatgaagcaaaggcgcttctggcttggcaagaatttttacaaatgtaaagaccacttgattcttatcttgactaacataattggcagcccaggtattgctcgtctttttcagacggtagagctgaccgaattgtatagtttcacgaatggagtgataggtttcgatttgctgactgatttcatccaattccttttccgaaagtttcgttaaatccagctcgtaaccaaatgctcctcccatcatagccacattgcctcgtgtagcaagaggtgtgatccgaccaacctgatggtttggaacggcagaaacgtgtgcaccaattgaggaagggggataaatcaaactagtaccttcttgaatagataagcgctcaatcgcatctgtatcatcacttgcccaagcttgcggcatataatacatgattcccaaatcattacgacctccaccgcctgcacaggattcgaaaagaatatccgggaaccgctttgtaaggtggtctaatacacggtagagacctagcatgtaacgatggtggaactcaaagcgctggtcatttgctaaaccttcaggaatattggtgatattacggttcatatcccattttacataagaaatattggctgattctaatatggaagagacgctatcaatgatgtagtcacagacttcctgcttggtcaaatccaaaactaattgttctcggctgtagattggtaagcgtccttctgtccgaattgcccaatcaggatgctcacgataaagatcgctatcaatagaaatcatctctggttcaaaccacaatccgaatttcataccaagctcatttattcgctctgctaaaccattcaaaccatttggcaacttatccaaattgactttccaatcgcccaatgaactttcatcattgtttcgtttaccaaaccaaccatcatccagaacaaacaattcaataccagctcgacttgcaacctgagctaactgtaaaatcttttcttctgtaaattcaaaataggtcgcttcccagttgttgattaaaatgggtcttggtttgtttacaaacgatgatcgaatgaggtgttttgtgataaagtgatgactattttgtgtcatgccagtaaatcctttatcagtatatgataagagaacttctggagtttgaaaccggtcatccttatccaattgccatgagaaatagtgactttccaatcctagtcccaaacgactggtttccatggctgtcgtttcgacaaatgctgtaaagttgccgctataaacaaggtgggctgcataaacatcgcccttgtcctcacttgcatcgggtgaaactagtgctaaaaagggtgttcttgagtgacttgaagcacctcgaatgctaccaatcgaatactgaccttttgtcaatggggtctgtgtccactctttttcataagcataacgtcctgccaagctgtgaacaatgaaatcctgatgtggaaaatcaagcgttgcagacaagaccttctctagtttgcatggatatttgccagtttgaattgtagctgaccgtgcgagataggaagcttcttcaaaaacagaatactgaagagttacggtaatatctgtcaactgatcgtaaagatcaatttcaagactctctacctcttcttgatttccaaaacttgctggtaatcccctcagttcttttttccccttgtataatcgatactctttgtattttaggtcaagagtgactccaaattcattccgaacatctaatgctgaggttctaaaatctcccagaccattgctggaatattcgagtgggaggacatccaatgagtatgtcctatccccagtaattggactcggagaaaacgatcgatctaaatatgttattttgtttccatcgctaaatttttcgatttttttcccaaaataacgatgaaccagatcgcctgtttccaatacttggatgatataagagaattctcttgttttcaggtgaaaaatctgtttttcattataaatctcaatcacattcatctctcctatctcttctttatggtcttattgtacaaaatgaaaacgctttatttaatggtcttttgtatttaaaacatgttataatgtttcctaggaggattgaaatgaatgttctaaatatctataatgaattggatagtcataattttgacctaaatgtagaccattacggtgccgaacaatgtgacaagggctattccttcggtcctactatccgtgataattttgtcctacattttattacaaaaggaagaggaaaaattcttgttgacggaaaaacaagctatcttgctgcaggtgatttgtttattctgccaaaggatgtttccattttctatcaagctgatgatatagacccgtggacctatgtatgggttggttttagtggttcacgagcaaaagacctacttaatcaaagtcaactgctagaaaactactacctccactccaatctagagtcaccaattctaggctacatgcatcagattaaccatgttcagatgcatcccatcccctctatcacagaattggtcttaattggctacctcaaccaactcttagcagcactcatagaggaatttcccagtgaaacattaattaagcctgaaacacaaaccaagcactatgttcagcaagccatcaagatgatccataaccactatgcccatccaattaaagtttctgaaatagcagattttctagctttaagccgaagctatctctataaaatttttaagcaggaaactggctattctatcaaagattatattttacaagtaaaaatgaatcgttcttgccaactattagaagatgcttctcggagtatcactgaaatcgcctattctgtcggataccaagaccctctcaccttcagcgcggccttcaaaaattatttccatataagcccgacagaatttagaaaaacacaaaaaaataaggattaggtgattttactcacacctagtccttatttctttatccaaaaaccttaccaagtcgctgacaggcttcttcaatcatgttgaatggtgctgctacattcagacgtgcatggtgcttaccttccttaccaaaggtcaaaccatcattcaaaatcaacttcgctttacaatgaagaatatcaaagagctccgcatactctaattcataggcagaaaaatcaagccagatgaggtaggttccctgaggcttcatgaccttgatccttgtatgggttgtcaaatactcctcaacaaagtctatatttctctccaaaataaccttcaactccttcaaccactcatctccataagtgaaagcagcttctgtggttaacaagccaatcgttggaatctcgtgctgattatttatcaattgacgcttagcgaaagtcttgcgaatacttggattttcaatgattgcaaagctattttttgtaccagcgatattgaaggtcttggtcgcagatgataagatgattgaaaactctttaaaactttcatccactgtgttaaaggaataatgcttgtgaccatacaaggtcaaatcttgatgtatttcatctgagacaaggataacaccatgtttctgacaaagacgtccaatggccaacacttcctctcttgtccaaactctaccacctgggttgtggggattacagaaaatatagagtttcacttgattctctacaatgtccttttcaagctggtcaagattaagcctaaaaatactatctacatcaactagtgaattggtcaccaactgacgattgtttaattttacagtccgcgcaaagggtggatagacaggtgtattaattaggactgcatccccttcttctgtcaaagattgaatagccacagataaggcaggaacaactccttcaatgagtagaatagactctctttcaatcttatagccatgctgtctatcttcccagtcaataatagactgatagaggctgtcactagcatagggataaccaaaaacgtgatgaactgcgtagtcacggataacttggcgaatttctggtagaggctcaaagtccatatctgctatccacaagggtaagagttctttatccgtctctacttgtctccatttttccgcatgctgggatagacgattcggactatctataaaattatactgtgtcatatcttatccctccaaggctgtctttaaatctgcaatcaagtcttccgcatcctctataccaatagacagacgaagcaaatcatctgtcaaaccgtaagaatgacgggtttcagctggaatgtctgcgtgggtctgagtggctggataggtaatcagactctctactccacccagactttcagcaaaggtaaagactttcagggtgttgagaatatggggaatccgactttcatttaccaccttaaccgaaatcatcccaccttttcctgtgtagtaaacttgcttgactgctggactcttctccaaataggcaacaattttctgagcattttgtgtcgcccgctccattcgaagcgagagggttttgagtccacgcatgagtaagtaagaatccagtggagatagggttggacccgatgtattttggtcataaaagagcttatcatatagggcttgatcattggtcatcaaagcgccagctagtacatcattatgcccagataggtacttggttgctgaatgtaggacaacatccgctcctagaacaagtggattttgataaatagggctgtaaaaagtgttatcgacaatcaccttaacacctttggcatgggcgatagccgaaaccttagcgatgtcaaactccaccatgagtgggttagtcggtgtctccagataaacatagtctgtctcttcggtgatggctgcaatcagctcctcctcggtgtttgcataggtaaattgaaatctaccgatactctcttgctcattgaaccagcggaaggaaccaccgtacaaatcacgcgccgctaccacttgactccctacaggaaaaccattaaaaagtaagaccagagcagccattcccgagctcgttgctagggcatagtcggccttttcaatagctgccaaagtcgtctctagactggcacgtgtcggattttttgttctcgtgtagtcataacctgtcgattgaccaaactcagggtgttgataggtcgtcgaaaggtggataggggaaatcaaggcacctgttctctcatcgctattgatgcccgtatgcgctaaaatcgtatcaatcttataatctgtcataacatctactccaatctaacttacaatatagtctagcatgaaataggagatttggtgtgaaaaatatccaaaaatacttatagaaaaatagcaagctttgttatagtttttctttataacaatatccatactggatctaccaataaatacttttaaacctataatttatttgatataataaaagaaagagaggtgattgtcatgaaattccagtttaacaagcatttctatcggtatagtgccttctattctatgattttttggacttgtttttttctgtcagacattttgctagacccttcccaaactcctgcatggtatagcctactagcctgtctgattatttttatcaatgccatttgggtattcttcttcaaagaagaaaaggagctcactcgcatgggttacatcttctatatcggattgattgtagtgattgtttatctgagatttattttaggtaagtagaaaggagtttactatgtctaagaaattcaataaagcattctatcggacctgggaattttacttgtctcttgcctgtatcctacaagtgatttatgctgctgtaaacggaccgttttggtttatccattttctcaagcttggagtcggactttatgctggttatctagctttctttaagtcacgtagctggataaaaaaaacatggcaaatttatctgacgattggattgattgctagttggataatcatttccttctttgtattgtgaggattttatatgtttaaggaatttaataaagaatattatcggagtttgaatttttatctgatgatattgttgtttctaggaagtatcggggagtggctaaataagggacctagcctctggcttgcactcttgctctttgctactgttggtactgcccgtagtgccttttggtctaaagaatggaccttaaaagcaaattggcaaatctatctctgtatcgccttcttgcttgttggagcttgggtagaattttttgtttaagagttgggagtgggaaagaactcgactaagtcaaaaagagttcgtattcccacccccgcacagttgattaggtcagatttggagtgtaaaacacgaacaaatctgccaatcaaccactgcgctgagatgttgacacgaacactgagaagtgggccagggctttttgcccagcctcttttctttcaaaataaacagtgattttcattcaaagatggtataatatacctatgcaaaaaattgatttactagacggagagcggattgaccagctcttctcgacagatgttcagattattcaaaatcgggaggtatttagctactcgattgacagcgttcttctttcgcggtttccaaaaatgcctgctcagaaggggttgattgttgacctttgtagtggaaatggggcggtgggtctctttgcttctacacgcaccaaggctcagattattcaggtcgagttgcaggaacgcttggcgaatatgaaccgccgctccattgccctcaacggtctggaggatcaggtttcggttatcaatgacgacttggcaaatctaccccaatatgacctacggtccaaggttgatttgatgctctgcaatcctccctacttcaaggtggataaagagtcaaacctcaatgaaagcgagcattatctcctagccagacatgagattgcaaccaacctagacagcatttgtcaggtggcccaacaggtgctcaagtccaatggtcgcttggccatggttcacagacccgaccgatttttagatattttagacacactaagaacctacaaattggctcccaaacgcatccagtttgtctatcccaaggccagcaaggaggccaatatgttgctgattgaggctatcaaggacggctcggtggacgggctgcacatcctgccacctctggttgtccatgaggaaaacggcgactatacacctgccattcgtgagatttattatggaaaataaggcctacttgtatgttttggaatgtgccgacggaagtctttatactggttatacgactgatgtggagaagcgacttgctacccataatcgtgggaaaggggccaagtacacccgcgcacgcttgcctgtcagcctgctctatcaggaagactttgacagcaaacaggaagctatgtctgccgaggctttgtttaagaaacgcagtcggcagagtaaattagattatattgcagaaagaaaacaagaaaatgcaaaataaaaaacatatccaccgccttcgcatcatttggcatatcttgagagtgactggttttgccacttttctcacttcctttttcagttttatctttctagcagctggtttgctactctggttggagcctgattttaccagctacggtgatagtttatggtacagctttgtaacggcgacgactgttggctatggagatatgctggtcaccactgcttttggacggattatcagcattatcttagctatttacggcattctctttttggggagcctgtctggattagtcgtcagctactataccgaggtcagcaagcattattctttagcaatcaaacaggacaagcaaaaaactggctcttaggaaccagttttttaatagctttccaaaatctgatcaattttagccattgcctcttcaaaaataacctgagactgacttggatcggcagattgcccttcgataaagacctgatgaatgtcttcaaatccaagaaactcaaagatagacttgatatattgggcagctggatcttgacctgcataaacaccaccattggactggatgtgcaacaattttttgcccttgaccagaccgatagagccctcaggtccatacttgaatgtcagtcctgcaacgttaatggtattgatccatgacactaattgacttggcacattgaggttccaaaggggattgaccacgacaatcttatctgctgcaagaaattgttgggtcaaggcattgtagcggcccaactgctctgcttgttcagggctgatagcttcgcctcttttagctgctcccatagcctctaacaagggcttatccaaagctggtatttggtcctcaaagacatctactatttcaatccgatcttctgggtgcaaactggcgtaccgtgtttgaaactcttccaaagcccgcaaggcgtaggacttttgtgcgtcaagtgggtgggcttttacgattaatagatttgccattggttctctcctttgttatccgttattactaattattgataaatatattctactctttttgatttgaaattcaaatcatttgctcgaagcaaaaggctggtctcccagcctctgcttttttagattgttttattattttaaataggtgtaagcgacacagtccaggctatcaacggctgtaaagccaattgcctcatagaaagaccgtgttttctcagtattgtccgtcaagagatgaagctgataaatacccggaaagtgggtaacggcctgctccaaaagctgacgcccaattcctcgtcgctgataggttggtaggaccaagatgtcctgaataaaaacgattgaatgcccgtcgccaactgctcgcaagagacccactagacggtcaccgtcaaaggtagcaagaacgagcagactatgttccaaggccttctctagcatttctggacggctagtatatcctgtccaacctacagaagcatagacgtcaaggacagcttgaaaatcgagttgaggattttgtttgtaagtaatcatgtctttctcctttgtattgttttttagaatacaaaggctttgtccattgttaaaacgcccatggtctttcctcctgttttgctacatttagtataacaaaaactgctccaattatgaagcagttttgtaacgacgataaaaataatagagactcaaggttatgacagatgtaccaaacaaaatcagcacaaggatagatagggttggtgagcctaatagactaactagcagcaataacccaccaataatgaagagatagcctgactgctttcttccctttcgttctatttcattggtcttgctatccaattcctccttgggtaaataattccctattaccatatagccgatagccagcagtccaatgacaagcctacggtaatccaattctccgcctaaattataccagagtaaagaaacttgaatgatgagagccagtagcggaaaaagccatttgaacactcgaatgactggtgttttccctatccctttcacatcataaagcacacaaataaataggtgaacacaaaagaatagtagcggtgtcaaaattgtcaccatatacttagccatagagccatttggctcaccatttacgccaaaatgcgttaccatggtatctggcaatgctccatagtaataaatcgtcaataaagcaatcagtaggaatataccagaagttgcaaataaggtttttatgtcaattttcttcatcttgttgccctccaaaacttgcaatccaaaccaagacttcttcaaagaccgtatagtttagacgataataaataaaatttttctgcttttcctccaaaattaatccagcttttttcaaagtggataaatgatgagaaactgttgctcctgttaattgaaattgttctacaatttccccagcagacttcggccccgacttaagactatctagaatttgcctacgaataggagcagaaattgccttcaaggtttcagacaatcccataataagcctccttgtccatctatttagaaatatttctaaatagaattatactctgtttttattgtttgtcaagaactatttcgattattttctaaatagatttcaaaaaaaacagaccactctttatggtctgtcaaatccggcttatctctcccctttattgcgaatcacaaagcctgttttcttttcacttgatgtgcgttggtgtggttttttgttgtcttgacggcggttatcgcgcttgaacttgtcatcgcgacggttgcggtcgttacgatcaccacggcgtcctccgcgatcacggtcgcgacctccacgtccacctttacccttggcttgaccaggtgcaaacttgaatggtaatggtttttctcgcgcaatttctacctctggcagactttctggatcctgaacagtcaaggtcaatacataaagcgctaactcttcaggggtaaattcagccgctaactgaatagcatctttcttgaacttatcaaaattgttacggatggtttcatccgccatttcacgctcaatcttcttcaaagcaacttttttcttggcttcaaaggcctcttcagctgtcgctggcttgagccctttcatgcgtttcttggtcaaatcttcgataatagccaagtagcccatctcgtttggcgaaacaaaggtaatagactgacctgattgacccgcacgacctgtacgaccgatacggtgaacatagctttctggatcctgtggaatatcgtagttatagacatgcgttacaccagaaatatccaaaccacgcgccgcaacgtccgtcgcaacgaggacatcaatctggtcatttttaaagtcacgaataacacgaagacgcttattctgatccaaatctccgtggataccctctgcacggaagccacgcagtttcaaaccacgagtcaattcatcaacacggcgcttagtacgaccgaagacgatagacaattctggctggtcaacgtccatgaggcgtgtcatggtgtcgaatttttcatgttctttgacacgaagataatattggtcaacattgacattagtcaattcctttgctgcaatcttaacgtgctcaggctctttcatgaatttgacaccaatacgcttgattggctctggcatggttgcagaaaacagaagagtttgacggctttctggcacacgttcgatgatggcttcaatatcatccaagaagcccatgttgagcatttcatcagcctcatcaagaataagggtttcaacaccgtcaagcttgagagctttacgtttgatcaagtccaagagacgaccaggtgtaccaacaacaatgtgagcaccagaacgaagggccttgatttgtttttcaatgctagaaccaccgtaaacagagcgaacttttactcctttttcacgaccaaatttgaaaagctcttcctgactctgcaccgccaactcacgcgttggggcgataatcaaggattgaattgcttgattgtttgtatcaatcttgttgagggttggcaaaccaaaggctgcagttttccctgtccccgtctgcgcttgaccaatcacatcttttccttccagagcaagcggaatggtctgctcctggattggtgacggcgtttcaaaaccagccttctcaacggcaagcaaaatatcttctgataattgtaaatctgtaaatttcaatgtattctcttttctaaaaggcagtgcgaagctaccttatctaacttttttgtaacaagatatcagggtcgaaccactgatattggatttgcaacttaccaagtataacacaatctaacaataatagttaatatttacctttaaaaagtcaataatacgttttcatgaggagtccatcattttatagacatttgaattagctttgatacatcgatactttcggtttgccctactctagtaccagctccttgtctgaaagttatactcttcgaaaatcaaaatcagacgttgttgacttgatttgatgaacttcagttctatctgcatctgcgtcgcctagtctgtttttgattttcattgagtattaattcattcgactataagaaaagagaaacctagttatacatgcacaactaggtttctcttgtatttttatttatgattattctttttcaatgcttgcaagaaccagtccaaacttttactgataatgacaaccattaccaatgtccaaaatgtttttacaagcccaattttaaaagccaaaggagttaccacaaatacatcaaaaatgagaataacggtggaaatcttccatttgaaatatttattacacaacaatgcaataatatcacttcctgccgtggacccgtttccataaatgactagagccattgataaacctgtcaccaatcccgccaagagagcagagggaatcaggggcaaccattttatttgcagaaaagtcgtataatgcatggttaaggacatagtagcaaccgctaagaaagtatagaaaaccgttaacttactcaaaaagcgataggctaatacaatcaaaatcccattcaaaacaaaactggacagacttgtttcaatccctgtcgtataaaacaaaagtagggtaacaccagtaatcccaccttcgccaaattcatgtggaatgatgagcatattcaaaacaagggcatataggattgccccaaaacatatcaataagcagtctctccattttatctgcgtcatattctctcctcacaaacagtccaccttagtatatcaaaaaaagcagaaagcggatagccactttctgtacttttttcctattttcctaagacagctgaagccagagctttttgaatagcaatgacactcttatcgctcttaaactgaagaatttcagcaggttcaacagccgatgaaatccatattttcagctcagcatctaagtcaaaatgaccagaggtttctaccgtaaaacgtgaaatcgagcggtaaggaatcgatttataagatacctttttcccagtcattccttgcttatcgaccaaaatcaatcgatattctgtaaaaacaatcagatcacgaaccagactaaatgccatctcaacctgttcattatccagtagaacatgctccaattcctgttcaatcttatcattatccatttgcgaggcattgcctagtaaacctgaaaatagtcccataatatgactcctttggtatttttctatagtataacacaaaaagctactagttgactatcttaggcactaggtctttaccaaacatgagaattactcgcttacctttgcttccttatcaacttctttaggttgattgttctcaatactgccaccttcaactgctggaaaatgttctgcaatcgcagatgggatcttctgatcatttagatttaattcttccttcggaatgtgattttcactcacatcaattgttttcaaagtcttattcggctctgtaatggcaagtgtttcaatatcattttttgaagcattcaggtcttctaaggctttgtaatcattgactccttctaaattcttcaattgattatctgcaacatttaatcgaacaaccgattcttgtttaccctctatttccaaagtcttaatttgattcccctctacatccagatttactaatttttcattttcttctatcccttgtaattcagtaatcttattattcttaagagtaagactagttaaatttggattgttttttacaaactgaagatcttttacattactttcattagctgtcagttcttctaaattctctgtttttagagttgatatatccaattgaggattctgtgatatatacaaacgggttaacttcttcttgttttgaagcgcagataaatctgtgatacgattattatctaaactaacagctgtcaattgtgacaaatctgctaatggggataaatccgtcactttattatgatctaaatttaaagattccaaagcttttaatttagctagaatagtgatatcttcaatgtcatttcctgcagcagaaactacttttaagtttggaaattcttccaaaaagcccaaatcagaaacaccattttgtgataagtcaattccctctaatgttggaatttctttcaaaaattgataatccttaacgcctgtgctagtcatccataattgtttcaattttttaaattgcaagataggttttacatcatcaattggcgtaaaaccaatccctaacacttcaacatttggcatcaagtccagaccggctctctttagcggatcttttcgctgaccaatatttagatattttaccgtttttaaccactctctcatcttctcggaatctgtttcattagatgggaaaggagtatcggccgtagcatgcaaaatatcttcaataatctcatcatcaaaacctaattgttttaaagtagccattccaattttatcatgagcatgtgggtcaccgtgagggtcttcgattggttttccaacttcaactttctcaatcaagattgtatgagaatggtcaccatgagggtaaacgaaagcaggtcctgcatctgtttctatcaccttgatttttgcttttgaaacatgcaggttttcggctaggtagctctttttagcttctcgttcttcttctacacttgagttaggtttcccaccttcttgtggtgacaacggaatttctacattaacttgagtggaagttgacgaatggtattctgctctagcagtctctaaatactgagtaggaatataagactcccacggacttcctatcaaatgactgtacggaagtaaatgagtatgagtaccatggccaatgagtaaccctaacgctgtttgaccttggactccgctaccatcaaaaaggaaaccgtcgcttgttggataatcaatacctgggaaagctttctttgaattagactgagtggaagtatgccctttttctgtggtagacttgagtgggacgaaattatttcttgtggtcggagtatgcaacgaatgattatcaagaacagtaatctgtcccttttttccaatggtctccccagtatttccttgtccgtattgcaaacttgatttccaaatataatgataatgatctccatgacgtaccgtatagccattcgcatcttcagccactacatccttcggatcaaatacataaccatcatcaaaagtttgtgatagcttcgcttgctttgcgttggaatgcgagctggattggctattctcaatgtactctttgggtaccagataggaccatttgctttcttttaaatccttatagaagataaaatgtgaatgaccattatgttctaagaccagtccctcatccgtttttgaaagaatttgaccttcattttcaaaaagaaatccatcatccgtaggataatcaacaccagctaccccttttttagcttgagaagtaggtttcttttgatttttggtgagtttcttagcttcagaaatagaaattacattagcatctttatccttgggatagtagaagtactgctcatttacttttataatataacctttctctagctgatactgaatatcttctttattcaatttataatcagaatctggaagggtatcttttaaaaagtgtgccgcatacgggatcggaccttcaaaaaagtatgactcttctccatatagacgcatatagccattagatttaatttcagacactacaatcgtattttcatctacttttgagatattgctactttgaacatcttgatgatttattgcagtattctctgttttttggcaacccgccaaaaaaagatgacaagataggataatgcctgtcaaggcaaataaggttgttttctttttcatttttgtcctcctaagctcattaaccagttaacaattaactagtatacattttatttttgatttttgcaagaaaaaacaactgacaatgattgttcgtgaataaattttccattccacgacaaacgcatgaaaaatttgttttataaaccatattttcacgactgctgtcagtttttagtagaaaaaatgtaatataatagccttggaaatgggggtatccttgttaaagtgcaagttttacaaaaaccttaaaaaaatgcatacaacaagaaaatagttacatacctttttcttcatgcggattgcatgtttccatccctacgatcattgacaaagcaaacaaactatagtatattaaaaatagggaaataaaaggagaatatatggaaaatacatctactcaaactttcgaagaactcgttgcggaacagaaaaagaaacgtaatcgcgtccttagaattattatcacactctttaccactattatcgtattttttgcctgtcttgcattattcaaatacaacagtggcaacattagcggtacgtggcgtaattcccaagctgaacaagatattgtcgaaaccagtatcaaggaattgcaaaatcaacttccaggtattgataaaacgtggattgacgcaacttatacgatgacagtcgtagataagaaagctgtcttcaccgctacaacaagctttgatattcctaaaatcgcaaaattaaccttggatcaagcttacaaggtaatgttagaggaagcacaaaaagaagcaagttctctgggaatttccgtagaagaatacttaacaaccgctctcggagcagattatgaaaagcaattgaaatcatttctacctacacaagctgaggcggaaaaagaatttcataagtaccaagacgaatatgctaaagaactaggtgccacatacaatcaagaaactggtactatctctgctacctttttcgaaggagacgtcgatcagctcttccatactgtgaccattacaaaaattaatgacgcagcaatcaaacagctgactacatacgatatttccgtaaaagatattatttcctattctcgcaagggaaataccaccattattaacggaaatgaagaatttactttagaaaaataataaaaaaagctgggaaagtcatccctgatggttccgacctcacccacagaataatgaaaataaatatgaagccctcactaggtgtataatcttagtgagggctttgtgcttgatgagttaatgatgttagtcatcgccggaaaaactaacccactctattgacgagctctaaaaaatatgcaatagacatgagcataagaactagccaataaaaacacagatagattcaagctaattttgatgaaatacagccgaattgtctgtgcttttatttttgtctctactatagataggacaacattgtgacgatatttgaaagaacttgtactaatactcaatgaaaatcaaaagtagcctaggaaacgaagccgaagatagaactggagttcatcaaggcaagttgacaacggataattttgattttcgtagagtataacctcctgtttgtttcatcacttacagtgtagtccttctgaccttttttgcatattgaatttaactaatgtcaccaatataaattattttctcttatataaccttttacatacctgataaagaataggtacagcaatgatggtcgtaattgcagtgccataggttcctaaaatcctacctaaagcagctaaaaataatactgatggcgttagtccaccgactaaactacccgtcaatgtgtacttcaacaggttcaagataatttttgtgagggctgcaactatcccaaccaacataatatttgatagactatcgtttgcctgtaggaatttctcataaaataagtgtaggacaaaacagacaatgagtgattctagaatggtaatccaagcaacggaggcatatcccgacagtaaatcaaagattcctagaccgagtgaggctgccagcgccccttttttggcaccaaagattagtactcctactaccaccagagcattgcctagatggacaaattgactcccaaaaggaatacgaataaagaagacaaccacacaaataagggctgcaaataggctaatttctgttaattgacgcaattgattctgtttcataatttctcctttaatatttgaaatgcctgctgtaattctgctagaaaaggttcaaaggaaatcccaaatttcaagtctctatccaaagcaagggtacgctctaaactcttatcgataaaatctaaagctagagggatagcttgatggagattgatttgttggatggttgctacagccaacaaggtagatagaatgtcacctgttccaaagaaatttgctggatattttttagacatataggtagttatttcccctgtttcctgctgaaaataggctacacctatttggctatcatcaaaggaaatccctgtcagtacaatatctgcggatacctgctctgctaaagcttccagtaagtcctcaatatcatgaatatcgtaggaatctcccaaatagtttctcccagtcaatagagaagcttctgttatattcggaagaatgagctgggccgactgagtcaattctttcatggcctctacataggatgatgtaaaacctgtatacagtcttccactgtcacccataatcggatctacaatcaatggtgtctctgtttgtttagcatacatagccaattgacttagttgctgaggatttctacagtagccagacaagatgcctgccaactccaaattcaagttcttccactgttcaaaataggcttgattcaagtcagtcatatcttcaatgacaacatctgggaaaccgcctgtgtgtgaggataaaagaactgtaggtaaaagcattgtttctacctgacaagctgctgcaattgggatgctagttgctagtgcaaccttaccaacaccaggtaagtcgttcgcaagcaataatcgctgcatgataactacctcctaaattatttttcataaacaaaattgtaaaggattatcatacatttttcaatcttacatatccgcaactgtatggggacagatagctgaaaccttgcaacaccaggctcaaattattacataagaaaaacagcaacaactctttgctactgtcatcctcttcaatgtattgttgtcaaattctgtttaatatttctccagaaaggcaatcagggtctgggcagaacgttctcctgcttgaatgataaattcatcaaaggtgatattggcatctccctgagctgtgtcactcatggcacggataaccaagaatggcttacctgtattgacagctgcttgagcgatagctgctccttccatctctacggcaaggacttctgggaaatgagttttgattgtagcgattctctcctgacctgcgataaaactgtcacctgtcacaatcagacccacatggctaatcatttcctgctctgctaaaacggttcttagctgttctaacaagacttggtcggctggataatacaattcctgccctgccatttgcccgtaagcatagccgaaagccgtcacatccacatcgtggtaagccaattgattcgctacaaccacatcaccgatggcaataccttcagcaacagctcctgccgaacctgtattgacaatgacatcaaccgaaaatcgatctgccaaaacagccacggacatagctgacataaccttaccgatacctgactgaacaagaacgacttcatgttgaccgattcgtccctgatagtaagttcgacccaagacatcgatttcagttgcatcttgtagatgctcgaccaaaatctttaattcctgaggcatggctgcgataattccaaatttcatctcttctcctaaataaataatactgcaatgataaacattatcagtaagatgatgacccaaaaaaggattttgtttaccttactgcggaaagcttctcgcttgatggtttcgatacggcgactttttactacagtaggtttgaccgggattcggatcgtttgtccctcttcatatccctgataatcttcttctagatatggatcgaatagagcatcatccattgatatatcctggtttggacgatagtgtccaaactggctagattggtcggaatactgtttctttttcactttctctaaaatttcatccgtcaacaagggcttgcccattgctagtttcctactttctcatgagttgtaaatattggatagccatgatggtctttgcatcacaaatatcgccagtagccaccaagttcaaagcctcttccaaggttacctcatgtaattcgataacctcatcttcatccattggacgaggattttcaaccttgataaggttatctgctaaataaaggcgaattcgttcattacagaaaccgatggctgaatagaaatctgccaacaaggtcaatttgtcactagtatagcctgtttcttcttctaattcacgcaaagcagcatcttcaagcgtatcttcttcgcccagctccaatttccccgccggaatttcataaatagtacgttcaatggccttgcggtattgtttgaccaaaatcattttaccttctggggtaacggctaaaacgcaaactgctcccttgtggaaaatgagttcgcgcttaccagttccaccatttggcaaggcaacatcatctactactacatcaaaaatgtgccctttaaaaatttctgtccgctcaatggttttttcttcaaaattcatatgattacctatttttgacttggatggaacggaaaacgagtcgcataaccttctttgttttcttgacgaccacgaccaataccgatggcatcctctggaatgtcttttgtaatgacagaacctgcagccaacaaggcgttgtccccaatagttactggtgcgatgatggttgaattagagccaacaaaggcattatctccaacggttgttttaaatttatttttaccgtcgtagttgacagtaatggtaccagcaccaacgttaacattattgccaatcgttgcatttcctaggtaggtcaaatgaccagacttcgttccttgaccaagtgtagaggccttgatttccacaaagtttccaacgtgaacatcttttttcaagagactacctggacgaatatgggcgtatggtcctaccgtcacaccttcttcaataacagattcttcaatgtctgagttgctgatgactgcatctgctgcaattttggcatcacgtacacgagtaccattggttaaaacagtacgttcaccaatcaccgtttgccctttcaagacaacattagcttcgataacagcttctgcaccaatctcaacatcaatatcaatataggttgcatctgggttgataaatgtcacaccattgaccatgtgtttttcattgattcgtttgcgcataacagcttctgcagtcgcaagagcgacgcgatcattgacacccaaactttcatcaaaatcacgcaatacataggcaccaaccttctcgcctgcctgacggaaaatcgaaataacatctgtcagatagtactcaccttgggcattgtccgtattaatatctttaagcgcttcaaaaagacgtttattatcaaacaagtaggttcctgtattgatttctttcacttgtttttcaaaatcgttggcatctttttgctcaacaattttttgcacttcaccatcagcattgcgaataatccgaccatatccgaatgggttatcagcctgagctgtcaagatagtcgcaacattcttgtggctgacatggaagttaataaggttcttcaagctttctcctgtaatcagcggtgtatcccctgcgataacaagggtctgaccttccaaacctgcaagagctggctcagccatcataacggcgtggcctgtccccaactgttcagattgaagggcaaactctgactgaccttcgagaactgcttggaccaattctgccttgtgaccgacaatcgttactgttttagcaggttccatagcatctacagcccgtttgacatgctccaacatggtaattcctgccactttgtgtaagacctttggcaagtcagacttcatgcgagttcccttacccgccgctaggataattgcatagttattgctcatagttttctctcttttcaatgatataccctattatagcaaattttgatgtttttggaaaatagcaatattatagggaattttcgtaaataaaaaagaaactggaatgaagccagtttctcaaaaatttctagtattagaaaacaaactacaggttgattgcatcctatagaattgtctatttaggataaaccaattcaaattcttcacagacgaccagcatatcttctgagaaggacaggcctgcttctgccagccagatagtgaaaagctcttcatggatctgtcgccagtggatcagacttttcgcttttatgtcagacaagtcacctccctgacggaactcgccctccttgtaggcatgctctgctgtcacttgggaaaagggcgtcacatagaccttggtggtctggataatgcaaacagcctgaccttgtccgtccagaatgatgtcatagccaccagctcttgggatttcttctccctctacttcatagagagcatgggcagagctggttgaagttttgatgcctctagccaccaaatcagccagtcgatcagcttccgccccaaaggcccaagcctccggctcaggacctgcttgggaattgatggcaatgaattcttgccagagttgtgtcggggtcatagggggtcctttctagaaatttgccaattcttcgcttgatcaagtaaagcctcaaatccataagggatttgatttagaagtgtttcggttatcccaaactgaagtatctcaactaaagcaattaattgaacatctgcaatgtcatgaatatctccacaaagaaattgccacatcccatcttccaagtcatgactgatgtaggttatcggtttattctcttcactatgtgtttacagatcactactgctacatgaggattatcatcaaaaatcaacatcactttcctccctacttcaaactccagccaccgtcaatggtgataatctggccttgcatggaagcgagttttccagtagccagcatgaaggtcagctctgcgatttcgcttggttgggtccagcgtccgataggggtctggtctgccacccagtccgccagaccaccaggctcaaagtccttctgggtcatgcctgtctggacggcaccaggagcgatgccgaagatctggaccttgtccttggcatagtccagtgccaactgcttggtaaaacctgccaaagcgtgcttggaagcggtataggcagagccacctccacctgctagactggaggcaatggagcacatattgataatgatgccagactgtctgtccaccatttgctgcagataggggcgagttagtctagtcaccgcaaaaaaattcaccgcgaagatctgagctaattcgtcctccgaaatatcgaggtggggtcggtaatcgtctaaaatgcctgcggtgttacagaggacatcgactgactggcaccaggaaaagacgggcgataaatcgcctgtcaggtccagctgtagaaagtggaaatcgcctgccaaatcaggcttgctagccagatcaatcccgaagacacgccagccattttccaaaaaaatccctgcctgtgctagaccaatgccgctggaaacgccggtgatgagggctgtcttagtcatggacttctacccagtcggtcgcaaggacatcgcaaggggtcgggctccacatggagaagccttcaccctcgccggtcacgttgatgaggaaatagggcgtcgcctctagcttctgcccgtggacctcgatggtgtcaaagagctggacgtagttctccgccccaccccagcctgtgcgaacgtactttttcttggccttcaagcctggtaaaatctcttcaaatgtcatgattattccttttcttatttattttaacacaaatgttttcagtaacgaataagagttagctaagtactctcttttgttgattgataaatctgtagatagaataaaatcatggcagcacatagaagaccaatcggtagccaaactgtccataaatcaccactaaccagattcatcaccaataattttttgataatgcctatcagtaaaaaagcaaaaatcggtaaagcaaaggttctgaatactttcaccttaacagagaaaactatcgtggccaaacttgtcacaatcacaaataaccaatcgaacatttctggaaatttcaaatagattgccttatctccaatcattgctggtaaattgaaaataatgttaaaaagaataattattgttaggacaatcaagcctataatcattttagaagcctttggcttaaaaagaacagatggtaacagaccgaaaaccagccaacaaagcaacaaagcattggtgcaagaagccaaaaacaggatgaattctaattgaaattgtcccgtgtttgcaaacaaaaggaaggtgccaatggcgtacaaggttgcgaccgcactgaaataggttatcgtcatttccctcaagggagccttcggtgcattttttaaaagttgatctgccatatctttggggtctgttccaaaaaaatctactgctgttagaccatcaacctcagccattttgaaatcactgaccatactataaatctgttccaaaatcgctttttcatctttaaaaaaggatttcaaaatcatatagtcgcgtatctcatcaaaataagctttattttcaggtaacaaattatctacaattatatttgtcttatctcgcaagacttgtttatcgcgtttcattaaatattcctttctgaatggttcctactttttctacaagacttgaccattcccgccaaaaatcccttaaataactctctccatcttgggtaatcgtaaaatatttacgatctggcccgtccgatgatggttttatctcgccaatgatataaccattcttttctaatttttgcaagagaggataggcagttcccccgaccatgttttcaaagccctgttttctcaattcctgaaccagctcataaccataaatctccttctgactgataatttgtaagacacagccgtctaggaccccctttagcatttgggtttctttcataagccctcctcatcatctgtaaaaaatccaaacagtaaacctgatcctaacaggatgcctaagatcaaaatagaatccaaggcccagcctgttataatggccgtcacaagcgtgattcctgctagtttccaattttcccgacttttcttctccagtttcatactgcctccctacctagtttgtaataccgactagtttgataaaaataaaagtgattttctttgtcttctatcactagtttgttttacctattagctttgtatctatagtctaacacaaggtggctagtttgtaaaacaaaatagtgaaaaatattcaaaaaaaatcatgaccacccgtcaaacgggtggtttgaacaagggctataagcccacatcaccagccagcgcctaaagacgctggctttcactttgttcaagcctcactgcttttgactcgtcactagcctcttaaagaggcattcgtactacttgccattatccctaaagggatcttcatactcttttacactcaacttatcaagtgctatatcatgtttttcctgttcttgtatatatttcttaattgtggcttcatttagtccaaccgtacttacataatatccctctgcccagaaatgacgattaccaaatttgtatttgagattggcgtgtttatcaaacatcattagagcactcttaccttttaaatatcctataaagcttgatacacttaatcgcggaggaatactgactaacatatgaacatgatccggcatcagatgtccttcgataatttctacgcctttataagtacacaaacgtcggaatatttctcccaaactacttcgatattgattatagatgatttttcgtctatacttaggtgtgaagacaatgtggtatttacacagccactttgtatgtgataaactatgtgccttttgcgccatatttttctcctttcgctttacaataggcttgaacacctttattgtatcgcgtttggagtttttttggtgtaaccttcgtcgcgcacccgcatagcgggtggtttatttgtcacgcaccttacggagcgtgacggactaaaagtcacataattaaaaacttgggttgccccaagtttaggaaataatctgtttgtaagatcgtgttgtgatggcatagaccactaggtagaggaggagatagccaccacagatgcctgcagtcacctgcaacataagccctgcattgaccacaccgatagacaaaagaatggacgagagcatcttgtaggcaaatgcaagatggacaaaggcaagtaggataggtaggaaaaagacggtcagcaattgcttgcgaatggactgtctggtctgatcctcatccagaccaaccttggtcataatgacaaagcgatctctgtcttcatagccttccgaaatctgtttgaagtaaatcaccagcaccaccgccatcaaaaaaatgagtgaaagtaagaggccgatgaagaaaagtgaacctgcaaaactgaagaaactacgcatcgcataggcacggtaggcgagactgatggcgttcgttccattcggtaatatattggactcccaaagctcactttcaaaactaccggataagaagacctcctggctatttacctgttcttcttctgatagactgctttcaaagcccatataatagcgattttcggcttgattttcaaatattgtcaagtcttgaacaacaataactaaatacttactaaaattaaaagtcacatggtctggcagatgtcccaaggtcacattcttgggcaagacttgggcaacttccatctccttttcatcaaaggtgagggtttgaccagcttgatactggactcccttactataaatggccacttggtcagctgccaactccagtttttgactagtcattttttcatatgtagctttatccaaaatatagcctacacctacttgattagaaaaatccatccatgactctttttccgtcaaaaatcttacttgctgatttgccacctcagaaaaataggcttgctgataaggatagactaccttactttcaacaggaatatctgtctcttctaagatagcttccgcccactcctcccacttctccgtttgagcttttgaagtggttggctgcataccaacatcaatcgaatagtcatttggattttgattggcaatataatctttgccaccgatgtaaatattgagtcctccaaccatggtcaccaagaacatgctggagaggatagtaatggtcgcaagacccagtgcatttttccgcatacggaaaatcaagttggatacagaaatgaaattatctggcttataataataggtctgacggttctttagccagtttaagagactgatgacacctgcgtggaagagcaggtaggtcccaaagataaccagaagagtcgctccaaagaaacttggaatagcctgcatcggactggtcaccagctgggcaatggcgtagcctgcccccaataagataagaactaagagggtttgtagccagaggaagcccgttttcttgtcccctcgcttcttaccttgaaccagtttgagtgagtcggtcaagcccagatttccaatattaaaaaggctgaccaaggcaaaaatcccaaagagatagataaatacagtgactagacttttcaactggaaggttgaagccaggaccacaggcatctgcatggctttcagcaagagcgcatagaagagtttatctagagccagtcccaagagcaagccagctagaatagtaccgactgaaaagaccagattttctagaaaagtcatcaagaagagatgttttttctccagaccaagaatgctatagacaccaaactcttttgaccgctgcttcataacaaaactattggcatagaagaccatgatggcaacggccagcataactacaatcataccgaagcccagcacttgaatcactccattggcccccttgacctgacctaaatcaggatgaaaggcaagtgaggcaaaaatataggcaatggctgtggacaaaatggtcatcagggcatagggaaaatagagtctgcggttctttttgagattggtcagagccaatcgaacggttagtccaaacatactactcacctcgattcgccataagtgtcaaggtatctgaaatcaactgatacatttcctgactagttctctcacctcggtagatttgattgtagaggatgccatccttgatgaagagaacccgtttggcacgactagctgctactgtcgagtgggttaccatcagaatcgtttgcccctcttggttgattttttcaaaaatatctagaagagttgccgttgatttagagtcgagggccccagtcggctcatccgctaagagaatttctggctgggtgatgatggcacgcgccaccgcaactcgctgctgctgaccacccgaaatctcgtagggcatcttgtcttgcaaggtcgcaattcccaggctattgagcgtatgaacgagtcgcttgttcatctcatcaatcggatagcgagacaaaaccagaggcaagagcacattatccttgacagaaagagtatccaagagattgaaatcttggaagacaaagcccaatttctcccgacgaaaggctgccgcttccttgctcttgatagattgggtatccaatccgttaagcaagaccttgccctgcgttggcttatcaagggttgccaaaatattgagcaaggtggacttaccagaacctgactcacccataatagcgacatattcacccttttccactgcaaaatgaatatccttcaaagcttcaacctgtcccgccttaaagagagaactgtatatcttttgaacgtgttgaacatctaaaactgacataacttgactccttttctttttctaccctcattctacacggtcccaagacaaactaccatagtcctagctttcatttgcgtgacagttttgtaagattagtaaaaaatcaactccacttctttgataccgattcgcacctctgttccctgacctacttttgattttagctttagggaatagcccagctccgcagcaattttccgtgagagatagagccccagacccgaagattgctgggttctgcggccattgaaacctgagaagccacgctcaaagacccgttccaagtcactctctgcaatcccaattcccgtatcgcgaataaccaaatcatctccgtccaaaacaatcgaaatggtcccttcctgacaatacttgagggcattggataaaatttgctctatcaacaggcccagccagcgtttgtcggtctttactgtcctatccaactgccccaagtccaagctagtattgacctgaatgaaaaagagggaatactttcttactagatttctgaccagttcatccaaattaactgattcgataaccaaatcatcatgaaaggactgtaagcggagatagttcaagaccagacctgtgtattgctcaatcttgaagagttctgtttctagctgatgacggactggactactatctacttccttaaccaagagctgactggctgcaatcggcgttttcatctggtgggcccagagggtgtagtagtcatctaattctgtctgttcctgtcgctgtttttctaggatttgcttgttctggacttctagtcgctccactttttcctgcaacaaacgctcactggctgtcccagtagtcactttctgaccacgccagatttttccaaagcgggaaaattccctgacaaaatcccagaggagggcgaggagccaacaaatactgcggaggaggatggcatagaaaaccaagtttcttttgatgtcaaagaggctactataagccagaatagccacagcaaaaacggcgtaggctatcagaaaaatcaagcgatgaccaagccatgatgtcaaaaatactggtactaatgagccaaaatcatccttattcatgtgtccacaccaggccgtagcctactcctttcttggtcgcaatcacatctggcagatccagttctgccaatttcttacgcaggcgagcgatgttaaccgacagggtattgtcatccacaaaaatatcactgttccagagttctctcatcagctcctcacggctgaccacttccttgccatgttcaaataaaacgcgtaaaatctgaaattcatttcgcgtcagctcttccacaacctgtccataggacacctgcatggtctttaggtctagggagatctcctcaaaccagagtaaactttgttctccgacaaagtcataggttcttctaagaagcccctgtattttggccaggagaaccgtcatttcaaagggcttggtcacatagtcatccgcccccatattgatcgccataacaatatccattggctggtcatgggaagacagaaacataatgggcacacgggatgtcttgcgaatttcctgacaccagtaatagccattgaaaaacggcagaccaatatccagtaaaatcaaatggggctgaaactcttccatctgttccaaaaccatctgaaaatccttgacctcttgcacctggtaaccccagtttatcaagtttttagcaactagttggctaatcgttttatcatcctcgataagaagaattttctgcataactatctcctttcatatccctactatttattatagcttacattggaacaaatttgagtatttttatacatttacacaagaagtagactataaaaccaggtcatcagtggtgcagatttgtcagaccaatcatatttcgttatactagataaaaaaggaaaggactgctatgccgaatttattaacttatcttgaagaaactcaatacgataatttttatgataaacctatcaataagctagatattctggctctgaccgaactttcctacctcccttttgataatctggtcccctactcttttacagaaaatggtgtacgacttgatcggttggcagcggcctttgaagagacctacaaaaataatttccctcccttttctatggtgaccaaaaaccgcctagccttactaggacttctatccaaatccaaacgcttcaaatctatcaaggcatttggcttcgttgacgattatcagttggaacaggaaaagcagttttcagcaatcagctatcgcattgaccgaaaaacgattgtgacttgcttcagagggacagatgatactattatcggttggaaggaagatttccacatgacctatatggatgaaattcctgcccaacgtgcagcgagtggctacttagaaaaacttatgatgcagcaggggggccatttttatctggccggtcattcgaaaggtggaaatttagccctctatgcagcatgccagcaagctacagaccaacaggatagaattctagctatctatccctttgattcacctggcttacacaaaaaacacttggaagcacctagttaccaagctattcaccaacggattttccctgtcattccccagaattcaatcgtcggtatgatgttagaaacaccagaaaatgctcagattgtccagagtaataccctcggcattctacaacacatcagtttttcttgggaggttgacggaagcgacttcaaaatagcccctgccctgaccagcgatagcctacaaacagaccaagccttaaaaacttggacggatagtttaacagacgatgaattacgagacttcttcgatttgtttttcggcatcttcatcaaagcaggaattgaacgatttagcgacatcacggtaaatcccctacagaaattacaggaaattgatcgactgagaaaagaaatagctccagaagaagccgaaatggtagacaaactcattcggctcctctttgacacccgctaccaaatttggagggacaatattagcacttccattccaagccctgaaatctctctaccagattggcggaaacttttccaaagaaatacaactgaaaataaagaaaactagctcaaccacttgagctagttttctttatcaaatcttcttaaaaattgagataatttttctaatcctttgattagagtttcttgttcacaggcaaaacctagacggacatagccgtcacgatcaaaacgattgccaggaactagaagaacaccgtattcctgcagaagttgcaagcaaaaatcttccataggcatatccactgcaatcttgacaaagctagtggaaacaaccgctggacggatataggaaacgaggggttcttcctcaatccattggtccaaaattgctaaattttcttctaaaatgcgccgatttcgttctagaatttcttgataatgggccaaagctaattgagccaccagatcgtcaaagacacctgcacaaatcatagtgtaatcccgataatctctcagaatgtccgtcacttgatgattggcggccacccaacccacgcgaatacctggcagagaataggtcttggataagctatttacagcaattcctttatcatagacttctataatagatggcacatccagctcagaaaaggaacgatagacttcatctgataggatgtaagccccaacttcactagcaatttccgccaattcttccaaataagccctatccatgacagcgccggttggattattggcattgttgatgcaaatcatcttagtgttaggacgaatgagctgacgcagtttttccaagtctggcaaccatccatgctcttcctcaatctgccacaaatccacttctgctcccaaagactttggaatatcgtagagttgttggtaggtcggataaagggaaatgacatggtctcctggctcaatcaaaccataaagaactaacaagtttgcccctgttgccccgttggtctggagaatttgttctggcttgacgcctgtatagagttgactaaccgattttttaaatgctggcgaaccttctatccagccatagttgagcttggtgccctgtaatttcttataaaaatcctcaggattggtgcccgacaaggcaaatagttcctccaaagtcaatgaagaaatagacactcctgcaatatcataaatcgcgctgttttcatggacattcagccattcctcaacgccaaaacgtggtaatttcataagacttcctacttttatttattctacccttattgtaccatattctttcaataattgtataaatatgcaacataacaagtaaagaatattactattattaaaaaacagactttctcaaacgagactgcctgctctgcttttttcccttaaaacttccctaaattcgtcaagtcttttttgtctggcatgacttccttgttgtcccagtgctcgacaatctttccgtctttgaggcggtagatgtcaaagtgggcatagtcctgacctgcaatccagactttcgaataagccaccacataatcaccctgtcccatcaccttgaaaacaaagtcgtagttgacttgactctctaccagatagtccttataggctgcaccgccttgagcgatttcttggttgtgctgaatcagatcagctgccacatagtcctcaaacttctcgatttcgccattttgaaggacatcgaccaagaaacgacggacgattttcttgttgtcctcagtcttatctaggtcagtcagctcaaagtctgcgtaaatcgggtctgtttggccaatggtttttagataggcatcgataacatcccaatgctcaacgatacgaccattttcatctgaacggaagatatccgccgtcacccactcagcctcaccgtcattgagtttctggtggacatggacaaagacgaaattcccgtcctcaatggcacgaacaatgctgatttcccgcttgggattgcgtttgaaaaagtcctcaaagaaagccgtaaagccctctttctcatcaggcacacccgtactgtgctgggtatagctagctcccatatagttttcatgaacttccttgattttgccatcgcgaatgccacgaaggtaaagatttttagcgttatctaattgatgtgacatgattttctcctattttaacaatccttctcgttccaaatattccctcgccacttgctctgccgacttgccttccatatcaaccgcatagttcatctgggtcatttcctcggtcgagatgttgcctgccaagacccctagggcttgctccaactcagggtatttctctagggtttctttggacaatagcggagcgccctggtagggtgggaagagctgtttgtcgtcttccaggattttcagtttgtaagtgaccaccttgctatctgtcgagaaggcttctacaatttgcacatctccgtttttaatggcttcgtagcgaagggcaggctccatggtcttgacattgagttggagattgtatagattttttagaccgatattaccatcttcgcggtcgttaaactctaatgagaatcctgcgacagctgtctgctgcacttttgccaaatccgaaatcttttcaataccatttttctgagcataatcttccgttacagccaaagcataggtattctggaaagccattggtgctaaatacatcagaccatcctgttccaaaatcgcttctttagcgtaggtataaacctcctcaggattcgttgataaatccattggtgaatttttcaaaagagtacttgtaatggtccctgtgtactcaggataaatatcaatagaacctgatttgagtgcctcataaaggaagctagtctttccgaaattaggttttatctccaccttgatgtctgtctggtcctcaatcagcaacttatacatattgatgagaatttcaggttctgcaccgagcttccctgcaatgaccaactgttttgtggaaaaattaagcatgggaacataactagctccaacagtaaataaagtcaccaatagagccaataaaattgtcttgggtttcttgtcctgcaacagacgaatgccataaccaaaaagcactgcaaggacagccgacgataccgcaccaatcaaaatcagggctgaatcattgcggtcaattccaagtagaataaaggagcccaggcccccagcccccaccaaggccgccagagtcgccgttccgataatcataatggaagccgtccgaatccctgacatcaaaataggcatggcaagagctaacttaaattttttcaacttctcccatttattcataccaaaagcggttgctgcttcttccagagaagggtcgatttctccaagtcctgtcaatgtcccctgcaagataggaaagatagcataaataacaagtgctactactgctggcaaggttccgattcccataaaaggaatgaaaagaccaagcaaagcaagggatggaatagtttggaagatacctgttatttgcagactccactcggtcaagcgttttttactagatagaatcagtcccaaaggtactgcaattgcaatcgcaataatcaaagctagaagggagatgcgaaggtgttcaaaaagagcaattccccactcgtccttgcgttctataaaggtttcaaataggttcattacatacctcctcgagctctgataaattccttgacaaaatcattggcaggacgattcctcaattcatcaggacttcctaattgcacaacttgtccatcttgcatgagacagatgcgatccgccaatttaaccgcctcatccatatcatgggtaacgaaaactgttgtcatcttgaattcctcatgtaattccttaatcaagtcctgcaactgagccttactgattggatccagagctgagaaaggttcgtccatgagtaacactttcggatttgcaatgatggcccgcaaaatcccgatccgctgtttttctcctccagacaagtccttgggcaaacgatccagatagctgtctggttccaagccaaccttggtcaatagctctctcatcctcgtcagggtttcttccttgcccaaacctttcatttcaggaataagagcaatgttttcagctaccgtcatatttggaaaaagggctatctgctgaagaacataacctgtctccaaacgtaattcacgcaggtcgaaatccttaagtcgcttaccttgaaaaaaaacctctccctcggtctgctcaattagacggttaatcaatttcaacgtagttgtctttccgctaccactcggtccaatcaagacaaagaactccccttcttgaatatcaaaggtcaaatttttcaagattggtccactaaccttacaggtcagagatacattttgataatcaatcatcatcttctccttttaaaatagccatgagactctgactgtagcgctgaattaatcctagcataagctcctgttcctcctgactgagttgagacagcgccttattttccgcctcctctaagggatccaaaatgcgactagcaaattgttgcccctcctctgtcaatttaattttcttatgtcgcttatctgctggattctcctctaaaactaccaggcctccatccaaaaatttctttacagtagcattgacaacttgtttgcttgaataggtcttcttactgacccagttttgcgtcacacctccgggattataataaatccacatgagaatggataaacattttgcattgagtccatgtccacgagcatagtcttcataaagaccgacttgctggtcaaacatacgagcataatccttactccttttctcaacttccatcatccttccccctcctcagtgagcacaactaccttactaaaagcctctggtctactagtgttcaaaacaacaacaattttcacaacgacttcctcctgtaatcatgttagtcaatattttttactattttaccaaaaaaagaaaaatagtcaatcattttgactattttgagacatcaactaccttattatagattcccgtcttcatccattcaaacatattaaatccctgaaattatctgcttttaatttacacaaaacaaatgataatcagataacaaaactagcctagaaaattctaagctagtttcattttatccttcaactgcttctgaggtagtttcgcttgctacttctgaaacagtttctgataccacttcagtttgaacatcttcgatatcaatttcaatatcttcagacacaactacagcatcctcaatatcttcttctgtcaaatccactgtcggagctttagcagtttttgccttgatagcttccaaaatgtcagccgttgataagttttgttccgcaattttttccttgatttgctcaaaggtttccaaggatttttccttaccagacttgaccaaatcttctactgtcaattcaccagtttcaagttgagtttttacttcagtaaatcgttcagtcgcttgtttgcctaaatcttgtgccttagtgacaaaatcagcattgatttcttcatggttttctttatagtcattagcaaagtttacaactttttctttgactgttttaccagttttacttgctagaaaagcagctgcagcagctccgccggctgcccctaacaaaaggctagtccacacgctactagatttttttaccatttttttctcctttcttacctaagagagatgagagagttgacagagctgaaagagctccgccggcttttacagtacttgctccagcagacttggctttgactgtcaaatcacgcgctgaagcattcaaatctgatacagaagttgacaagtcagctaccgctacaaaaagaggatcaagggtcgaaaccttgccatttacatcttcgactaaaacattggttttagccaaaagctcgttggtctgatagagagtcacattgacatcgctggtcaagaccttaagcgtttgctgggcttcatccgttaccgtacccaattttttcaacaacaaaacaatatatactgccaccgccgcgatggacaaggcaataatcaagacagaaatttcaataatcatatcttctcctttagggttgatagaatggaatagaagactttcttctccgcaacacaaccatgataataccaacgaggattaacaccccagatagccattgtgaaacacgtattcccaagaacatgaggctgtccgtccgcaagccttctatcaaaaggcgaccacaaccataccagactaggtagaaagctgtaatttctccctgtttaaggaattttggccgtctacgtaacacacaaaccaagccaaagcctagcaaattccagagagactcaaacaagaaggttggttgacggtaggcaccatcaatatacatctggtctcggataaaggctggcaggtagttcaaactttctactgccttaccataggcctcttggttaaagaaatttccccaacgacctattgcctgagcaatcatgaccgatggcgctacaatatccaaaaaatccagggtattaataaagcgatactgggtaaagaaataaaggacgattgcacctgtaatcaaaccaccatagatggcaataccaccgttccagatagcgaagatagataaaatgttatccttatattcactccatgaaaaggcgacgtagtaaatccgtgcccctaggatagaaagcggaaatgcgattagaataaaatctaaaatatcatcctgacgaattttctttcgcggaccctcttttgtcgccagataaacacctagaatcagaccaagcaaaatgcagattgcataccaacgaatttctaagggacctaatttaatcgcaataggatccatattaagcctcttctctattgtgttcaattagattagacaagcgttcttcgaagatcttcgttgcatcaaaccccatctgtttggcacggtagttcatggctgctgcttcaattacgacagaaatatttcgaccggtttttacaggaatacgtatttgtggaatagcaattcctgctatttcgatagtatcgccagagtttcccaaacggtcaaataccttacctgtttcaaaattttcaagatagacagctaattgcacttctgatgaatctttcacggcactagcaccgtatagactcatgatgtcgataatgccgacccctcgaatttctaataagtggcgcagaatttccgcaggttcaccccagagagtaacatcatcttttgcatagacatcaacacggtcatcagccaccaatcggtgtcctcgtttaaccaactcaagaccagtctcactcttaccgataccagaatcaccctggataagcacacccataccgtaaatgtccatcaagataccgtgtacactcgtccgctgagccaggcgactatccaagtaagaagacaattctcccgatagacgactggttgctgtcttgcttcggcagatagcaatttgtttttcttttgcagccttgtacatctcctcagggatttccaagccacgtgccactatgacaacaggggtttctggctggaacatctgagaaagaacctgatagcggttatgggcagtcatggccatcaaataagaccactccttcatcccaatcaactggatgcgctctggagcataataatcaaaatagccagtcatttccaatcctggtcgggtaatatctgccgtcgtaatttgcttttgcaggagctcttccgtactgtaaacacattcaatccgcagattatcgaccaaatctttcacataaacggtcatttcttccctcactttcagttttattatattataccataagctaggggttgggggaaaaacaagtggctgatttggcaaaaagaatgagttctttctttttctcacaaaattagcaaaacttccacagattaaatgtacttctcttccttcgctacatatttttaacaaatctgttatactttatatagatcaatacttactactaaggagaaaatcatggaacccttgtttctcacacctgttatgcacgaaaaaatttgggggggcaatcgcttaaggaccaactaccactacgacattcctagtgataagactggggaatgttgggcaatctctgcccatccaaatggcgtaactactgtctcaaacggtcaatataaaggaagaggactggatgacctctataagaatgaaaaacatttatttggcaatccaacagatgatgtctttccattattaacaaaaatccttgatgcagacgattggcttagcgtccaagttcatcccgatgatagctatggcttggctcacgaaggggaactgggcaagacagaatgttggtacattttggaagccgaggaaggcgctgaaatcatttatggtcacaatgcccaatccaaagaagaactccgtcagcaaatcgaagccggagattgggacaagctgttgacccatgtacccgtcaaaaagggtgatttcttctttgtaccaagcggcaccatgcacgccatcggtaagggaatcctgattttagaaacccaacaatctagtgatacaacctaccgtgtctatgactttgaccgccgtgacgatgcaggcaacctccgtgaactacacattgagaaatcgattgacgtgctgaccatcggacctgttgctaactcaacacctgcccacctcaaagcaggcaatcttgactcgacacttctggttgccaatcccttctttaccgtatataaatggaatatccaacaagaaatcaaaatgaaacagacagttccttacctgcttgtcagtgtcattgaaggggaaggtgccatccaagtcggtgaaaccagctacccacttcaaaaaggaagccactttatcttaccagccaatgtgacagactggacatttacaggccaaatggacatcatcgccagtcacgcgaactaagcatacaaaaaacttgagcctttaaactcaagtttttttgcattattcaaaccaagacttatttatcttttccgcttcttttatcttacgtggacctgttccatagcgttccgcgtccctatcttccttataaggtaaaaaataagctgctgcaatatagagagcaattagaaggaggaaggatttgcctaagaggagacctgcaatatagttaaatgaaacaaaaacagtacatttatgatataatgtatttatggcatattcattagattttcgtaaaaaagttctcgcatactgtgagaaaaccggcagtattactgaagcatcagctattttccaagtttcacgtaacactatctatcaatggctaaaattaaaagagaaaaccggcgagcttcatcaccaagttaaaggaaccaagccaagaaaagtggatagagataaattaaagaattatcttgaaactcatccagatgcttatttgactgaaatagcttctgaatttgactgtcatccaacagctattcattaccccctcaaagctatgggatatactcgaaaaaaaagagctgtacctactatgaacaagaccctgaaaaagtagaactgttccttaaagaattgaataacttaagccacttgactcctgtttatattgacgagacagggtttgagacatattttcatcgaaaatatggtcgctctttgaaaggtcagttgataaaaggtaaggtctctggaagaagataccagcggatatctttagtagcaggtctcataaatggtgcgcttatagccccgatgacatacaaagatactatgacgagtggctttttcgaagcttggttcaaaacattcttactacccactttaggtaaaccatctgttatcattatggacaatgcaaagtttcataggatgagtaagctaaaagatttatgcgaggagcagggacatagacttttaccacttcctccttactcaccggaatataatcccattgagaaaatatgggctcacatcaaaaaacacctcagaagagtattgccaaattgcgatacttttcttgaggcactttcgtcctgctcttgtttcagttgactataaatatcgcgcgtgttacccaggattcccagaccaatttatgcgctatgccggcaagaaccccagatactatcttcccctgccttactttatataattcaattgacatcttttattcctttcacgtaaaagcccccttgacctgtttgtaccttcaagaaaagtaaatcattgccagatttttcaaactgatagggactatttttctttttccggttaaccaagacatgacctgattgcgactcaatctgcccccgaattccctggcctttgccagtttgtaaagtcaagggagcctgagctagttgcacatacaagtgttggggataaccaccgcaagtcgtcaagcgaatatcctgttgttttttatcccttgaactgcggatagaaatatcttcaaatggtaagtaatccaagcgagcatctgcctgaccaagttccaaatccagcaccgacatccattcctgaggcaagttgattgtcaaacgacaggccaagctactgtgaaaataaagcccctttttttcaacataaagacgaggaagcttatcttctggtgcatcttgattgtagcaaatctccacactaatctgattatttttagacttagccaaagttagacgtccctcagataattttaaaaagagtgattcaatcccttcaaaactataggattgtttcaatttggaggaagcaaagaccttaaaacttggcaaggtaaaattcaattttactttttcttccacaaaaagaaagtctggttcttgattcatttccttaaaacaggcacgcgcctcttccttggtcaagacacctttttcatataactcaattaagcgttcttctctcttttgcgtcatagactcacctcaattctactctagtatatcacatttctccacaaaaaaatcagcccgaagactgattctctattctttcaaagtaagtttaccccgacacttcccacatcggtatttttttaggtcaatgcggcgcttgcgctggtagacttgtccacaggactgacagcagtaaatcagactaggcttagtagcttgttccagttggggagcatagcgcaggccatccaccgcagctagcaattctttaaaatccctgtctccatgccgatagcctttcttctcaaagtagagatggtagtggcagagctcgtggcggacaatcttccgaaagacttctaaaccttgctcctccaaatgcttgggattgaaatccaaatgcccatcccttggaaaaaagcgaccacctgttgagcgtaatcgcctgttccagattgctacatgccgaaattccttaccgaagtcttgcaaggagacttcttgcacatacttattcagatccatttggtttcaaaaggctaagaccgatacgatttcgtttgatgtccacttcaaccacccagacggttacgatttccccaactgcgagaacttcgcttggatgtggcaaggcttgttggcgtccatttttatctcgtttgcgtttgaccatgcgtgaaatgtggaccagaccatcctcgtggacaccgatgtccacaaaggctccaaagtccacaatattgcggaccgtaccttgcaattcctgtccgactaccaggtccttgacatccaagacatcttgacgaaggactggtgcttcaaagtcatcccgtaaatcacgaccaggtttgagcaagtctgcgatgatgtccttcaatgtttcttgaccgacaccgattttttctgccgtatctgcgatggcaagctgcttcaatttttcctgcgcagcctcatctaagtggtcaatagctagaagttctaacagattttccacagccttgtaagactcagggtgcacgccagtattgtccaaaaagttagtcgcatcaggaatccgcaagaaaccagctgcctgctcaaaggccttgtcacccaaacgtggaacctttttgagttgctgacgagaggtcagagcaccgttttcctcgcggtacttgacgatgttctccgaaatggtcttgttaagaccagcaacgtgagccaaaagggcaggactggccgtattgacattgacaccgacctggttgaccaccgtatcgaccacaaaatccagactttcagacagagacttctggttgacatcgtgctggtactggccgacaccgatagacttgggatcaattttgaccagctcagccagagggtcttgcagacggcgggcgatggaaatggcagagcgtttttccacagggaggtctggaaactcatatcgcgccagttcagaagctgagtagacagaagctactattatagcatgaaagcggtacaaatggctcaatagaaaaagcacgtagataaactacatgctctcaatagctaattaaaattcagcctgatccgggtcaagtcgaccttttactccttctagtttatccaactttgcaactgctgtcggactaatagccaagccatcaatttccaaattcgccttaatattttctggactagttgatttcgggagagggagaaaacctttatctaaagaccaagctagtgccagctgggcaacactacaaccagcttctttagccaaatcggctgcttcttggctttggaaaaggcttcctgtaccaaatgggctataggcctccaagagaatccctttggctttgcagtaggccactaattctgactgaggagttcctggggccagcataatctgattagccatcgggataatctcagccgtttccagcaaagcttctagatggtgttccataaagttagaaactccaattactttcacttttccagcacgatagagctcttctaatgccttccaaacctgggcattgcgttccttccagccaatgctgtcgcgaacagccttgggatttggccaatggatcagtaacaaatccagataatccacctgaagtttttgcatggattcttctactgaagcaagggtatcttcatagccaatcttgtcattccaaaccttagttgttaaaaaaatgtcctcacgagctagaccactatcagctatagctcgaccaacactagcttcgttgccataaatctgtgccgtgtcaatgtgacgataaccagcttccaatgcataagaaaccgcaccgtacgtcacttcaccatcgggtatctgccaagttccaaaaccaattttaggaacagttacaccatttgaaaacgtatatcttgtcataaaagacctcctatttcttctatccccagtataaactaaattgtcaatcaatacaaaataatgcgacctaaaaataaaagacacccgaaagtgtctgctcacatttattgtatacttacttttcaaaatttattttcttggatagtttgtcgataacaacagctccaactaatagagaaagcaattctcctgctgctgttgtcaaccaagttagaaagaatggtagatcatataagacttttaattctaaagcaatggtaaacatagttgccgcaaaaaagaatgagaaataaaagaaagccttgttaaataatccaccgaatagatagtccttcttgtatttttcaaacaggataactcccaatgtaacgaagattaatgtcgagaatccacccacaaagaggtcaatcacaccaaaaccaatcaagttagaaatcatgcagccaatggtcacggcgataatatacttacgattataaaaagccaagaaattgagcatttcagacaaacgaaactgaacagccccgaaggaaatagcattcaatggcggtgtcaaggtaagagcgacataaatcgccgcaacaagagcaatttctgccatatctctggcagtccatttagatgtattcataaaattctcctttagcgaaaaagcttaaaatatgcttgggtaaagtgagcaagccccaagggtcattgaatttatcaacaacgttgattagtatagcatatttttgctaaaaatgatagactagtcctatgaaaaaactattttatcaactcatcaataacgaagttattctctatttgattgcaggtgtggcagcaacccttgtctatatggtcactcgaatggggctatttttagtcattccttccattctattggttactcttttagccaatgcagtagctatcctctttgccttttggaccaacgaccgtttcgttttcaaacaagccagagagggttggcctcagcgattggtcaagtttgtatctgcccgcatcgcgaccttggtcatggatatggctctagcctatttattagtacaagcctacccacaattgattgggcagtttgtcaaccatgatttgacacttgtcaacgccatttccactctcttctctcaagtcttggtcattgtggtcaactatttcttgagcaaactctttatctttaaaaatacgaaatgaggctccaacggaacctcatttttatatatagcttgattttcctacttcattctttatctatcgctgtaaatcttgcctttagcctattcaagatagaaacaatatccccatctctggcatgaaactcttctacctgcatactttgaaccgtagcattaatcattgcaccaatgatgagtacctgagccataaaaatgaaccaaagcataaaaacaagaaagacgacagctgttactattctaaaatccagcaacttattagcataattatcaacataaatcgaaaataactttccaatagaagtcatcgtcaacagaacaaataacgttcctggaaaaacatatcgaactttttttatccgaacatttggcaaaaagaaataaagcataaccaaggcggtaaacagagccattaaacctactaactgtgtttgactaagaagccccttcagccaggcgtcttcaataggaaccagcttattaatataagaaaaaactgcctgcccgaaagtcaaaagcgtaatacttaagaggataattacctgcagaccaattcctaaaaatatgccaatcaagtgcccaataataaaatcacggtgttcattgataccataagccttattaaaggccttctgcaaaatagtcatactacgtgacagggtccaaagagttgtcagaattgaaatccctaaccacgatgacgacggctttgttaatacagaagtgataaaagatgaaaccgaaggatagagcttgtctggcacaaattcagctacaaccgataaaatcatatccacatcaaatggataatatggcagtaaattcgcgagagttagaagaatagggaaaatagaaattaacaaatagtaagctactgcaacgcttgttacatcgctatcagcagaacgataaaaagaaaagaaggttgagcagaatgttttcaaaccttcaactattttggttttcttcattctctcctccttcctcattcatctattattcacgaccacaccgagaattaataggtcccttcttcaccttgactggtcaaaataaccggtccatctttggtgatgacaaattggtgttcgtattgacaagacaaaccaccatcaagtgtcttatgagcccaaccagtcttcatatccgtatcaatttcccaagtacctgtattaatcataggctcgatagtcaaaaccataccttcacgcaagcgaagaccacgacctttagttccataatgaggaaccatcggctcttcgtggaaggttggtccaacgccgtgccctaccaagtcacgaacaacaccgtagccaagaccttccgcatattcttgaatggcagcaccgatatcgccgatacgattgccaacaactgcttgctcgataccacgatacaaacattccttagtcacgtccatcaagttttgaacttcctcagagacctgaccaaccgcataagcccagcaggaatccgcacaaccaccacgataggtctgggtgattttcttcatagccttgacatcattaaagttgagcttagaaacatcaactaccgctttatccaaaggctcgctcaaaaccatatcgaccttcagtaaatcaccttctttaagtttgtaatgacgcggaaaagcatgagcgacctcgtcattcaatccacaacaagtcgcataaggataatccatcaattctccatcaacaccaatttggagtggcaaaacattcttttccttacacgttttacggacatattcctctacttcccacatgtccacacctggcttgataatctctcgcaaaccaatatgaataccagccagaacatctccagcacggttcattgcatcaatttctcgttgtgatttaatggtaatcattgattctcctcatacatttctaaactaaattcagccctcttcaagctaaattttagataatttcttgttttatggctatagcggtcacttccgcgatactgcgcaacctgtaccaaaccagcttttttcgccaccatctgactggccacattttcctcatgggtgacaataaccagctccctcagaccaaactcataaaaagctagatagactaaagtcctcactacttccgtcattaagcctcttctccagtagtctttttttaggaaatagctgagctccgcagaaagttgacgttcatctaccttttcaaagcaaagcgcaccaatcatcctctccgaatacttatcaactaaggcccagtttcccaatggtgaacgcataaatttttcaaccattgtcgaaaaagcaatatttctgtcctccaaagctggaaagataaaaggaagattttcgggatttgatacaatttcatagaaactttctccatcttcaaaagaaaatggtcgtaaatacaaacggtccgtttcaaagcaagcaaacttcgctagtcttgtccaaagtgtcatagtgtacccaaggggctgagaattactcccagccccagattgtttcgttttttaaatcgattacgttttgagaaagtagttctcaattagactctctaatcctcaatcaattgaatatctgcacccaattctgtcagtttatcaataatatttgagtaaccacgtagaataaactcaatgtttgtaatttctgtacgcccttgagccattaaaccagcgataaccattgcggctcccgcacgcaaatcagtagctttaacagatgtaccagtcagttgatttggaccttcaaaggcaatatggttgttacgagtagagatttttgctccaagatttgcaagctcctgcacatgaccaacacgtttttcataaatcgtatcaacaatcgtaccagtcccttctgccttaagcagtaaaggagtaatgggttgctgcaagtctgtcgcaaaacctggataaggtgaagttttcacacttaccgccttcaatttctcttgcttttcaacaaaaatactatcttcagaaatggtcatgcgaacacccatttcttccaacttagcgatgtaactctctaagtgttcataaaggacattatcgatacgaataccttcaccaacagcagcagcaagggcaatataagtccctgcttcaatacggtctggaatcacctgatgacgtgttccttttagactatctacgccttcaatggtgataatatctgtacccgcaccacggatacgtgcccccatattattaagcaaagttgccacatcaataatttcaggttcacgcgccgcattttcaataactgtacggccttctgctttgacagctgctaagatagtattaattgtcgcaccgacgctgacaacatccatgaagatatgtgccccttgaatacgctgaccattagttgccaagcgcatatagtcaccttcataggttgtctcagctcccattgccgcgaatgctttcaagtgcaaatcaatcggacgcggtcccaaatcacaaccacctggcaagccaacaacagcttgaccaaagcgaccaaggagggaaccgtaaaaatagtaggatgcacgcaagctattaattttgccaaatggcataggcatgtcttttacaccacgagggtcaatctccaaggtttcaccatcacgcttgaccgtcgcgcccattgtttccataatatcaactaagctatctacatccgagattgcaggtactccgtccagagtaacaatcccgtctgcaagaataatggccggaataagagcaacaactgagttttttgcaccactaacggtaaccgaccctttcagtgtttttccaccattaattacaatttttctcatactaacattcactttcttaatttgcctaaaaaggcatacgtttcattctatcataaagtcttggaaaaagctagttatatagcatgcaaaaggaccgagccaatgagctcagtccttcatatttatatacgattagtgaatctctcttcatcatttatgaaaaattctctgaatttgctcccttgcatccacgagatacaactccagctcttctctcgttaaataaggtactcgcccatagaagatatggtcaatgacttgagcaccgttgctattgaagagccattctgaggtcagggttttcatcgcttgatcaatcggtgtcagacttccatctgcattttgtggctgccctgttggcataaagaaaatagctttcttagtggaaaataatttacgtggttcatcagattcaaaactgtaagcaaagccatgttgaaatacacggtctacgtaacctttcataatagcaggcattccattccaccaactcggaaatatatagactagtaagtcgctttcggcaatcaaatccatttcaacttgaacatctgctggaaaaacagttgcctgacgtacaaatttaccatcctcaatatgaatggtatcttctccacgtaacacgggatcgaatcctatttcgtataaatctcggatgacaacttctgctccattttctagcagagcttccgccactctatcaaccaaagcatgtgtaaagctttcttttctagggtgtgcaaagacagacaattaacgctttcataaacttctcactaagtggacaactatttcattacaaaaccgcagttttcaaggcttccaccttgtccaatttctcccatgggagatcaatatcggtacgtcccatgtgtccataggctgcagtttgcttgtaaatcgggcgcttaagatccaacatctggataataccagctgggcgcaaatcgaaaatatgacgaacagctgcttctagcttgctttccgctactgtgctcgtaccaaaggtatcgatgcgaactgaaactgggtgagcaacaccgatagcgtaagccaattgaacttccgcctttttagccaaaccagctgcgacgatattttttgcgatgtagcgtgccgcataagatgcagaacggtccactttggtcgcatccttaccagagaaggcaccgccgccatgacgagaataaccaccataggtatcaacgataatcttacggcctgtcaaaccagagtccccttgaggtccgccaatgacaaagcgaccagttgggttgataaagtagttggtttggtcatccagataatgagctggaatgatttccttaatcacacgttcaatgacatcctgacgaatttgctcctggctaacttctggatcatgctgggtcgaaataacgactgtatccacacgaacaggttgattatcttcatcgtattcaactgttacctgtgacttagcatctggacggagataagcaatttcaccagattttctcaactcggccaaacgacgcaccaatttgtgactaagtgaaattggcaacggcataagttcaggcgtttcatctactgcaaaaccaaacatgagcccctggtcacctgcaccaatcaaatccaatggatcttgactagcatcttgacgagtttccaaggcttcattgacgccttgggcaatatctggcgattgctctacaagtgacggatgaaccccaaccgactcagctgaaaaaccatactcaccttttgtatagccaatctccgcaatcgtatcccgtaccacacggttaatatccacataggcagtggttgaaatctctccaaacacatgaacactacctgtataaacagccgtctctgccgctacgtgcgcatctggatcctctgctaaaatagcgtccaaaatggcatctgaaatctggtctgcaatcttatccggatgaccctccgaaacagattcagacgtaaacaacttacgttctgacataaaaatgtcccccttaaaatagaatatatgctagaaacctagcgggttactaaggttacaaagaactagtcaaagactagttctttgcgaaagacaactgtcttaagcaaagggaaatttccagatacccaacgagaaagacaataccagactatatgagagtagcctagctttgaagaaaatagtgactgaagtgtagtaaagtttttacgcttactattcaatattaccagtttctttaattgtgtttcaagtgtttctgcaaatattaactagtctataaactaccttttcgggacttaataacgtttctagtatagcatagattgaccgactatcctagcattttcttaaaaataaagagggttgttctatgcaaccactcttctacaaaatcattagataaattcggcatctgcaaatgcctgtttaaccacctctagaggcaaatgaaccaactcacagcccttttctttatacaagtactgagcatagtcatccatgcggtattcattgatatagacaacccgcttacaaccaacctgtaacaattgcttagagcagttgagacagggaaaatgagtcacataggcagtaaaaccttttggaattccccgctccgctccttgtaaaatggcattgacttccgcatgcaaggttctagcacaatgaccatcaatcataaggcattcctgatccaaacaatgttcggttcctgaaacagaaccattgtagcctgttgcgataaccttattgtccttaaccaaaaccgcaccgacttttgctctcttacaggtcgcccgattggcaatcaaaagcgcctgagccgcaaaatactcatcccaagctaaacgatttgttgacatgatttctcctttctccactcaatccaccatcccataaatctctaccaagtcctgtgctgtgacaataccaacaagatcctctggcgaatgaagcttcccactcgcctgacgactgactaggacggttgtgcgcttacgcccttcaaaatgattaattacctgataaagatgggctgttattggtagaacaatcacctgaatactatcttcctcacaagctagtacgtcttcaagactagcctccaccaatttttcacgtatagagcccgtttccttgcttgccttggccaaccaatttgtcaatcccttgtcagaaaccaggccttgataaaccttgtcagaaaaaataggaaacttagaaaaatgctcttgctccacaatttctaaagcctttgtcaatttgtccttgccctcaaaaataaccggcttaattttctgggtcttttgcaaatagtcggcaatggtaatcggttcttggtactgggctatcactttttccaaaacagtgatcaattcctgcgaaggttgggctacttccttcaaacctgttcgtttctcatgaaccatgagattacgcaactgacgagccacatagagtttatcccagttcgcctcaacgggattatgtcgcgtcaattcctttgctttggtcaacatagagcctacatctgcatattccccatccgcaacaccgcacaccttacgcaagaccttatccaagtcattgaataactctaaaaaacgggtttcattcatcttaatctaccattgctgatttcaaataggcatctaccatccgctcagtcgcaactacagaatccaaatgcgtccgttcataggaatggctagactcaatgccagcaccaagcagtgcatgcttgacatctgcacctgctcgcatagctgccgaagcatcggaaccatagtaaggataaatatccagcttataaggaattccatctctttcagccaaggctatcaagtgctgacgaagttcataatggtagggacctgatccgtccttgacacagatagaaaccgtgtactcatccgtctgctggtcatctcccattgcccccatatcgactgccaaatattcaaccacctgagcaggaatgctggagttggcaccgtagccaatctcttcattgtttgaaaaatagaaatgtgtcgtataaggcaaggtcgctccctcttccttatagaccttcaatagatggagcaagatagctgcggataccttatcatccaagtgacgactcttgataaagccagtttctgtcacgacggtacgaggatcaaaggagataaaatctccgacttcaatacctaaggcctgcgtctcgtccgcattggtcactttttcgtccaaacgaatttccatgttggtctgattgcgctcagcggtactggcatcccgatagacatggacagaggtctggtgcatgagaatagtacctgtgaaagtcttgccatttttagcgcaatgaattaagcagttttctccctcaatagaagggtatccaaatcctcccaccaaatccattttgagtcggccatccggtttcactgcacgaaccatggcccccagtgtgtccaggtgagcagtcaccatacggtgttcctgatcattttcccccggaactgtcaccaaaacaccacctttagcggtcttactagcaacatagccgaaactttcaacctctgccttgatataattcataatatccgtcgtaaaaccagttggcgacggagtgttggtcaatgtaacaatgtaatcaagtgtcttcatgaaaacctccttatttaaaactattatatcacgttttaggtgatttttttgctataatgaaggtatgaaaacctatcagaaaatatatctccttttaaaagagagagaggattatgtcagcggagaagatttggcacaggaattgggcatttcacggacatccatttggaaggccattcgccagttagaaacgcatggtttaactattgaggctgcccgtaatcgtggctacagattagccgaaggcgatttactcctacccgaattaatctctcaggagcttcaactacctgtccatctgaatatggatagcgactccacccagctagatgccaaacaaggtattgaatcaggtcatactagtcctgccctatatctagctccctatcagaataaagccaagggacgatttgggagacccttttatgcctccaagtcaggtggtatttatatgtcgcttcgtctctctcccaatgttccatttctagaatttaagccctacaccattttagctgcagctgctgttgtgaaggccattcaatctctttgcgacttggacgtccaaatcaagtgggtcaatgacatctatctcggacacaaaaaggtcgctggcatcctcactgaggctatctcttccatggaaaaccaacgggtaaccgatgtcattatcggtgtcggcatcaatgtccgcatagacgatttccctaaggaattacaacaatctgtaggaaatcttttcgaggaacaaccaccatttacccgcaaccaactcattactgccatctggaaagccttcttagaaaccgatgagaaggaactaattgccctttacaaagaaaaatcacttgtcgttggccaacaagtgagctttgtagaaaatcaagttgaatttaagggtactgccatcgctgttactgatacaggaaacctggttatccagttagataacggcaaagcaaaaattatctccagcggagaaatcagccttacttcttggtctgcttctccaccaaacgaataaatttagtcaccttgtaagcaaaatgaagattccgataggcgataaaggcgtagatacctgcaatcaagaaatctcctgtcaaaatcgatgcattcataaaataaacagctaaaatagttgtaatggctaaaaaaagaaattgtggaagtttcataaaatagattataccaaaaattcagtcaactggctgaatttttatatgctttcttgataggtttcgattcttttctaaacaagaaaacaccaatctaattggtgctttcttaaggagatatgaaaaatatttaggattgaatatagtataaaatatctatcaaaactattcatcagtcttaggactgatattttctaatcatttctaatctcaactgtatctgcgagaaagccaaattcttctgggactggactggcttctttttcgatttcctgtgtcttttgcccttttgctttcgccgaaaattcagcacgaatacttacccaatcttcctgagcaatagctaaaatctgtggggaaaaaccagctgccttgctgagaatatttccaaacatggtattgagattgtcacgcttcatcgtctgttcagcattaagcggagaatcaaaggctagaatcgcatgattttcattggcagcaactggctgggaaccaaccaacaaggcacgatctgcacctgacagactctcgataatttctccccaagcattctgcaagcgagtcaaattttcacgcgccaaggttggattttccatagcttcctgcaaaatagcatgaaccttgctggtatccaatcggtacttcttcggagcctgcggcttgcgtgaaactggcttaacagcacttggttgactagataattgacttagttgtttctgtaaatccgcaacttgttgttgcagactggctagttgccccagtaaatcagctggcagctctgccattgcctccgaaggagaactatcttcagccaaacgaatggtcatcatttcagcgtaaatcttgggttgaggactggacttgatgtccgccaaacccctggtcaccatctctatcatggtaaaaatccgtgcctgctcaagagctagattttctgaaaaaactgttgttaaatgcgtatcctctccacccgtctgcacgataaggacatctctcaaatagtgcaaaagatctgtcgcaaaacggctcatactctttccttggtcaaacaaggtttgtagatgctggagagctgtgacactatccccttgacgcagacttgccacatagtcatccaaggcacgcaagctgatagaacccgtaatttcctcagcaatttccaaggtcacttgctggtcctgactaaggctgagagcctgatccaaaatagatagggcatcccgcatccctccttctgcccgacgcgcaatgattgtcagagcctgttcgtcaaagattagcccttccttggttaaaattgcagccaagtgctcctgaatgtccgtcaccttgatggacttaaattcaaatcgttgcacccttgacagaatggtagcaggaatcttgtgcaattccgtcgttgctagaataaagaccacattttcagtcggttcttccaaggtcttcaagagggcgttgaaggctccagtagacagcatgtgaacctcgtcgatgatatagaccttataggtcgcaagactaggtgcataggtcgatttatcacgaatatcacgaatctcatccacaccattgttggaagccgcatcaatctcaatcacatcttccaggctaccttccgtaatggcctgacagatataacaatcgttacaaggctcgcctccaacctgattaggacagttcatggccttggcaaaaatcttagctgccgatgtcttacccgtaccacgaggacctgaaaagagataggcatgactgattttcccttgttcaatggcctgtttgagtgtggtcgcaaccacctcctgccccaccatctccccaaaggtctggcttcggtacttcctatataaagcttggtacattagcgtttttctccaaacatagcaaaattccagtccgtcttctcaaccaagagagcaacgaacttttccagatagtcttggtcaatcgtatcataatcagctaccaatctcgaatccaagtccaaaacgcccagcaactggtcgtttttcaccattggcacaacgatttctgatagggctgtcgcatcgcaggaaatatagttatcatgtagacgaacatcgtctacgagaatagtctggcgcttagctgcaacctcaccgcagacaccctttccaagtgcaatatgaacacaggaaacgcccccctgaaaaggccccaaaatcaattcactaccatcatacaagtaaaatcctgtaaagacagagtttggtagagcttgattgagcaaagcagaagcatttgatagattggctaaagcattggtttccccatcaagaagagcttccaattgagccaacaataattgatagtttgaaattttttcttgttttgtcataggaacattatagcatagttaagccgacttttatagtccgagcgataaagaaaaaggcttgcgcctatttccacatccagtacataatcactgcatcaatcaatacccctatagcccaggctagttgaaaatactttttctgtgtcttatgccgaaaatgggttccacctgcccaggcacccagcccgccaccaaaataggacatgagtaataaggtcttttctgaaatccgataggcgttttttcttgccttccctttatccataccataggtaatgaagacaagtaaattccaaactactagcgccatactaaccatctgtttgattgacatacattcctccaattaagtcacatttcttcttactctaacataatccaaaacaggacacaaggaaaaacgattcggaaatccgaatcgttacatttctgccagtgtatcctctaaccatttgagctgggcacggttgcgttcaatagcccgtgtcaaaatcaaatagtgtccataattgtcttggatactttccttggttgagaacagctcaactttacgactgtctaggtgttttaagtgcttggtgactagttcaatttgactctgcaacaaaccaggaatccgtgggtcatccttttcacggataaaaaacatcttgattgaaaacaagtttttttgctgaggcgtttcttcatttggaatggatagccattcgtctaaaatctgacgaccagtagccgtcatcgcatactgcttttccttttcatttccaggtactgcatgacaagtaatcaattcttccttggtcatacgttttaattctggatagacttggctatgggcaacctgccaaaattcgcctaaatcacgttgaacatagtcggtaatctgcttgccagttaccatttgaccgctagcacccataatccctaatatgatatgaggtaatattctttgcttcggcatcttaaccacgctctcttaatatactctccaccttggtgttaatcaagtcgatggctacaacgttgctgacgccttcaggaatgacgatatctgcatagcgcttggttggctcgataaactggtgatacattggtttcaccaccgaggtgtactgctcaatgatactatctaagctacggccacgctcttccatgtctctcttaatgcggcgaatgatacgaatatcgtcatcagtatcaacgaatatcttaatatccattaaatcccgcaaccgtttgtcttccaatactaaaataccttccacaataaatacatcttgtggttcctgacgataggtcttctctgaacgtgtgtgctgagtgtaatcataaatcggaatatccactgaacgtcctgctaatagctcactgatatgataaatcatcaaatccgtatcaaaagccagtggatggtcataattggtcagtatccgttcttcaaaggtcaggtgagactgattcttataataagaatcgtgttcaatcatagatatacgagcatttgggaaattatccagaatggcacgtgacacacttgtcttgccacccccagatccgccggttacgccaataataatgggtttctgagtcatcatcatctccttctattttcaatactattttaccatgaaacatggtataatgaaaaggataacacaaaagaaatgagaatttatgcttaattttggtattgttggcacctcagacatctctcatcgttttatagaggcagcccatttaagtggacattatcagctacaggctgttttctcccgtagactagaaactgctgctgccttttcagagcagtatgaaggagtcgatttatacacagaatgggtaaaatttctttctgctcccattgatgttgtctatattgccagtccaaatgccctgcactttgaacaggcaaaagctgttctagctgctggtaaacatgctattgttgagaaacccatggtttctacacctcaggaattagaacaattgcgtcgcgttgcccaagaaaataatgttttcctctttgaggctgctcgaaactatcacgaacaagctcaagccattatccgtgaatttttgacggataaaacgattttaggtggttcatttgggtatgccaagtattcttctaagatgcctgaattgttagctgggcaaatgccaaatatcttttcaactgatttttccggtggtgctctcatggattttggtgtctatacgctctacgccgctatcggcattttgggaactcccagaacggcccgctatgtagcacaacagctaccttttggtattgacttaaacggttcgggacaactcatttatgacaactatatcgtccacattcaagcatgaaaaaatattacaagcaatctagcgagcgaaatctatacaaatgatggaacactaacactcaacgcatgccagcatatcagctccgctattttcacaaaacatgacggagagcaaattgttttaccaatccaagcggcccagcatcctatgctcgaagaagtgttagaaattgcacaggcaatcaagcaacaaaaccgcaagcttgtggaccagtggctggctgtggcagaaagcgtccatcaaacactttacaccatgcgtcaagacgcaggaataatctttaaggcggataacaatgaaatctaaatttccctccagctggacggaccagcttaccctacttggctttgaggactttactcctatccaagtccaggcctttgagcctattgcaaacggcaagtcccttctagctatcagcccaacaggcacaggaaaaacccttgcctacctctggcctagcctattagccctaactcctaaaaaagcccaacaattgctcatcctcgcacccaatacagagctggctggtcaaatatttgaggtttgtaagacttggtcggagacaattgggttgactgctcaactattcttgtctggttccagtcaaaaacgccagattgagcgactaaaaaaaggaccagaaatcctgattggaacacctggtcgtattttcgagttgattaaattgaaaaaaatcaagatgatgaatatcaacaccatcgtcctagatgagtttgatcagctgttctccgattctcaatatcagtttgtcgaaaagattatcaactatgtgcctcgtgaccaccagttaatctacatgagtgcaacagctaaatttgaccgtcaaaaaattgctgaagacattgaaagcattgatttatctgagcagaaattggataatatccaacattgctatatgatggtagataagcgtgaacgtttggaaactctacgtaagtttgccaatatccctgattttcgtgctcttgcattttttaacagcctatcagaccttggtgcaagcgaagataaactactctataatggtgtgaatgcagtttcattggtttctgatgtcaacgtaaaattccgcaaggtcatcatcgaacgtttcaagaatcacgaactcaatcttctacttgctacagatatggtcgcacgtggtattgatattgataacttagaatgtgtcctcaactttgaagttccttttgaccaagaagcctacactcatcgttctggacgtactggacgcatgggcaaggaaggtcttgtcatcactctagtatctagtcctagcgaactaaaacaattgaaaaagtatgcctccgtccaagaagtcattctcaagaatcaagagctctacaaaatataatgaacaatatacaaaaggcttagaaccagtgtttctactaacatgattctaagccttttatcattcttactgggctgggccggataattcttgtgaataatagattaattgaggattgagaggactagcgagtaagtctgttacagtaaccatattgtagccctcacctgttaaatattgcaatacagactcgaggctatcaactgttgactgatgaatatcatgcattaggataatacttcctggacaagtctgttcttttatttctttcaaaatggcttggggattgcgactcttccaatctttagaattgaccgaccaataaatcgatggaagtcccatctgattgacaacggcctggttaacagaaccataaggaggacggaccattgttggtacaatacctgtagcttcagtaatagctgcctgtgtatcttgaatttctctctgtacttgctccccagaaatagtgactagattgggatgattccacgtatggttggcgatgacgtgcccttctgctaccattctacggagaatagcttcattcccaactacagccttaccaacaacaaagaaagttgctttggcattatattttttcagtaaatctaaaactaccggtgttgtgttcggattgggtccatcatcaaaggttagagcgacctgtctcaaatgtttcttatccacaacttgtgcagccatatactcatcatagccaaccttatcagcatctactagataatcactcttcactactgggtacaaatctgaaattggtagaaccaactggttgatgccgtaaccatctggtaattgtaaggttaattggctgtctccataactaaaggaaatagcatttaagtctagtgtttcaaattttttgacaatcgcttctacatcagtctctttcattccttgagcaagtaaggcttctcttagatgatcaacaataatacttgctgcagaggataaattaggtaataaatcttctagagtaaacaattcattgtcctgcgtcaataacacacgctcagacgggagtttatcctgctttttaatttgcaagttgtctactttatagtgctccgcttgaatttcacgagctgttacatttttaaaatttgtttttccctctattgatgaaacaaagaccagtttttgaatttttcctgctggttttttatgaccaaagcgtctttgaacataggaaatcattcgactttctacaggtcctaagacatgacctgcatcatctgtaggtaaggcagccacaacatgggtcgtatcaatatttccctcttgaattttgcccttgcctttagcgaggatggtttgttgtttttcctcaataaactgactaacctgtctttcttgaagtcctgcaaataaccatacagccaaacttaccattatgccgagcaaggcgatgttgattcccaaccaaaaactaacttttttcatctccaacctcccattcaaaacatatataaactatgctaaatcatttaaaggctcttgtcaagacagttctataaaaactcataaaaagattaggtaatactcttcgaaaatcaaaattatccgttgtcaactttccttgatgaactccagttccatcttcggcttcgtttcctagactacttttgattttcattgagtataaataattgatttgcttcctaattcccccctcctgccattttctgatttttttttgaaaagaaaaagactgcctaggcaatcttttctaaattaatctgcacgaatgacttccacacggtagccatctggatctgtcacaaaataataacgacctggacttcctggcaatcccttgatgtctgtcgttggatagcccagctccttatgtttcgcattgtccccttctaaatcatctgaagaaagagctagatgcgagaaaccgtcgcctacgatatagggaccatgatcataattgtaggtcaattcaatctcaaagtcatctccttcaagtgctaagtaaaccaaggtaaacttgtgctctggatagtccttgcgacgggtttccttaaatccaaatgcttcttcataaaatttttgagatgcttctaagttctcaacacgcaaacaagcgtgcaacatttttttacttgccataataaattcctcctaccatttaataccaccagtataccatactctctatgaaaaatccgatattcaaaatcatgaccacccgtcaaacgggtggtttgaacaagggctataagcccacatcaccagccagcgcctaaagacgctggctttcactttgttcaagcctcactgcttttgactcgtcactagcctcttaaagaggcattcgtactacttgccattatccctaaagggatcttcatactcttttacactcaacttatcaagtgctatatcatgtttaactcgctttttaagctgaagctcgtgaagaaatcatccactggataatttctttattcttgtatatatttcttaattgtggcttcattaagtccaaccgtacttacataatatccctctgcccagaaatgacgattaccaaatttgtatttgagattggcgtgtttatcaaacatcattagagcactcttaccttttaaatatcccataaagcttgatacacttaatcgcggaggaatactgactaacatatgaacatgatccggcatcagatgtccttcgataatttctacgcctttataagtacacaaacgtcggaatatttctcccaaactacttcgatattgattatagatgatttttcgtctatacttaagtgtgaagacaatgtggtagaacacagccactttgtatgtgataaactatgtgccttttgcgccatatttttctcctttcgctttacaataggcttgaacacctttattgtatcgcgtttggagtttttttggtgtaaccttcgtcgcgcacccgcatagcgggtggtttatttgtcacgcaccttacggagcgtgacggactaaaagtcacataactaaaaaagcctgagcgaactcaggccttaaatgaattatgcttccaagtagtactctttcacaatgttcaagttttcatccaattcgaatacaagtggtgggaagtttggaatttccacatccatgatttcgtcatcagacaattgtttgatgtgttttacaagggcacggattgagttaccgtgtgcacccacgaatacgtttttaccgtctttcaatgctggagcaattttatcttcccagaatggaagggcacgctcaagcgttactttcaagttttctgcatctggaataactgaatcatcaaggtgtgcatagcgacggtcagtgtgtgctgaatgctcatgatctttagccatttctggtggcaaagtatcataagaacgacgccagatgtgaacttgctcatcaccaaattcagcagctgcttcagctttgttcaagccagtcaaaccaccgtagtgacgttcgttcaaacgccacgatttttcaactggtacccacaattgatctgcagcttcaagagccaagtttgtagtcttgatagcacgtttcaatacagatgtgaaagcaaggtcaaattcgatacctgcttctttgatcaatttacctgcatcgattgcttgttgtgtacctttttcagacaaatcaacatcagcccaaccagtgaaaaggttagctttgttccattcagactcaccatggcgagcaaaaaccaattttaccatttatgaattctcctttaaattttgaggttcccctcttatacttctctattttacacgaaaaggtaaaaaaatgccagcctttccacaatctgtgtacgctttcattactctttcatgtaaattcagtctctagacctatctttcttcttagaaaaaatacaaaataatggtataatagtaaggctgaacacgacagttcaaaacgataccactataggagttatcatgaaaaaagtagctatcgtgtctgcctatcgttctgccatcggcagtttcggaggtagtctgaaagatattgaaatcgctgatttaggggcgcaagtcctcgaaacagccttagctagtaaaaacatccctgcagacagcgttgatgaagttatcttcggaaatgttctttcagcaggacaaggacaaaatattgcacgtcaaattgctattcgtgcaggcattcctcagacagcctctgcctatgcagtcaataaagtctgtggttccggtctcaaatcagtcctcctggctgcccagtcaatcatgctaggtgacaatgatgtagttgtggctggaggcattgaaattatgagccaggcaccttatctatccaaaactagcaggtttggtagtaaatttggtcatattactctagaagattctatgctgacagacggtctaacagatgccttcaacgactatcacatgggcattactgcagaaaatgttgctgaacactatcaagtcagtcgcgcagagcaagatgcttttacatacagtagccaagagaaggctgcgaaagctattgctgagggaagatttgttgacgaaattgttcctattagattaaaaaatcggaaaggcgaaactatttttgccacagatgagtaccctcgtctgacgccaattgaaaaattggcaacacttcggccatcttttaaaaaggatggaaccgtcaccgcagccaatgcttctggcatcaacgacggctgtgctgtcttgatactcatgtctgatgaaaaagccagtgagctaaatatccagccactcacctatattgaggcctatgcaacaagcggtttagatcccgcattgatggggcttggacctattactgctagccaaaaagcgctacaaaaactgaataaaacagtcgaggatatcgatctattcgaactcaacgaggcatttgcagcccaatcaattccagttgtcaaacaactcggcattgatcctgcaaaagtcaatgtcaatggtggtgctatcgcccttggacatccaatcggagctagtggtagtcgaatcctagtcactctgattcacgaattaatcaagcaagaaaaagagcttggtctttgctcactttgtatcggaggcggtcaaggcatctccctaatcgtttccaatgcgcaaacaagttaacctatcatttgtacacaaaggatatattatgaacatcggtattgataaaatcggatttgcggcacccgattatgttttagatttggctgatttagcccaagcccgcaatgtggacccaaataaatttaagattggtcttcttcagtctgaaatggctgtagctcctgtcactcaagatattatcagtcttggggcaaaggctgccgaagccattctgacagaagaagataaacaaaccattgacatggttattgtcggcacagaatctagcgtagatcaaagtaaggctgccgccgtcaccattcatggattactcggtattcagcccttcgctcgctccatcgagatgaaggaggcttgttacggtgcaacggctggactaagtcttgccaaaagccatatcgctcaattcccagaatcaaaagtcctagtcattgctagtgatattgcaaagtatggagtcgcttctggcggtgaacctacccaaggtgctggggcagttgccatgttggtaaccgcaaacccacgaattttggtcctcaacaatgataatgtctgccagacacgtgacatctacgacttctggcgtcccaactacgacaaatatccacgtgttgatggtaaattttcaactgaacagtacaccgattgcttgacgacaactttcgactactatcaacaaaaaacaggcaaaaccctcaacgattttgctgccatgtgcttacatattcctttctccaagcaagggcttaaaggactgcaagctattgctcaggatgaagaaactcttagtcgcttgacagaacgtttccaggaagctatcgtctataataaagtcgtcggcaacatctacactggctctatcttcctctctcttctttcccttttggaaaatagcagagcgttagagacaggggatcaaatcctcttttatagctatggtagcggcgctgtctgtgaaattttcagcggtcaactcgttgaaggttatcgcaaccacttacaagaaaatcgtttagaacaactcaatcagcgtacaaaactcagcgttaaggaatacgaacaagtcttctttgaagaaattacccttgatgaaaccggttcatcccttgacctaccagaagaccaaagtccctttgcccttatcaaagtggataatcacaaacgtatctatcgtaaataaaagccaaaacggcgccctttggctctcaccaaggggcgctttcctatagaaagaggaacctatgtcaactttttccggattttataaaaaatcacgccaagagcgcattgatattctccgtcagaatcgttccctagccgaagatagcttagacattctatacaaagacgaaaacctgccagaagcaattgcgggaaagatggcagaaaatcatctaggaacgttttccttacctttttctgtacttccagaacttctagtggatggacaaacttactctgtaccgatggttactgaagaaccttctgtggttgcagctgcatctttcggagccaaaatcatcgctaaatctggcggttttacaacgactattcacaaccgtatcatgattggacaagttgctctctacgatatttcggaccatagcagagcgacacaggcgattcttgaccataaggagagtattttagaaaatgccaatcaagcacacccttccattgtcaaacgagggggcggtgcaagagaattgactgttgagagtaaggatgagtttttgattgtctatcttcaggttgatgtacaagaagccatgggagccaatatcctcaataacatgttagaagctgttaaggatgacttagaagagctcagcaagggacaggctttgatgggaatcctctccaactatgcaacggagtcactgatcaccgcccaatgccatattgccatctctagtctggctaccagctctgccattgctcaagaaactgctcaaaaaatagccctggcaagcaaactggcgcaagtggacccttatcgtgctgcgacacataacaaagggatttttaatggtatagatgctgtcgttatcgctgcaggaaatgactggcgggcagtcgaagccggagcccatgcttatgccagccgtgatggacaatacaaggggctttctacttggtctattgatggcgagcacttggtcggctccatcaccctacctcttccgatcgcctccgtcggcggctcgatcgggctcaatccaaaggtagcagtcgcttttgaccttctccaacaaccaaaggcacgccaattagcttctatcatcgcttctgtcggtctctgtcagaactttgctgccctgcgtgctcttgttacttcagggattcaggctggtcacatgaagctccacgcaaaatccctagcgctacttgctggcgccgaggagcatgaagtagaccaactagcccaactcctgcggaaagaaaagcacagcaacctagaaactgctcaaaacttattagcaaaaatgagagaacattgggagtgggaaagacatccatgatggctccgccctcacccacagaataatgaaaacgaacataaagccctcactaggtgtataatcttagtgagggctttgtggttgacgagttactgatgttagtcatcgcgggaaaaactaacccactctactgacgagcaccccaaaatatgcgataggcatgagtataaaaatacgactacaattcggtagataagctctctaatttttagaaggagggaattatcatggaggttctctatcaatcttgtgcaggtattgatgtccatcaagccaatattgtcgtctgtatcctacatggaccactcacctcaactcgtccaaagcgtgagatggctacatttgatacaacgactaaaggcctacgtgcttgccacgattttctcagtcaatttcatgtggaagctgttggtatggaaagcaccggtgtctattggcgacctgtctggcatgctctatgtgatgacttcgagttgatactcgctcaaccagcccacatgaaggctattccaggtcagaaaaccgacaagaaggacgctcactggattgccaaattaacacggattggtctgcttcctcggagtttcgttcccgatgaaaccattcaagaattgagggagttgaccagacaacgaaaacattatgtggaaagtcgcaatcgagaaacaaaccgtatccataaaattcttcagtcaggtggtatcaagctaacaacctatattgaagatattatggggctatctggtcgcaatctccttcagctactggttgatgggacgcctattacacctcgcattgtccatcaatcagtttacaccagcttgaagaagaaagtgccgcagcttctggaagccttggatgactatttttctgaccatcaccgctttatgttaaagcagtccttagagatttatgatttttatcagaagcagattgagttgttggaagagcgaatgaatgtctatctatcacaatatgaaaaacatgtagaaatattggattccatcccaggcattgatgtcattacagcttctgttatcatttctgaggttggagttgacatgagtcagtttccgacatttggacatttagcttcttgggctggactctgtccaggtaataatgagagtgctggtaaaaaacgaagtaccaagattcgacacggaaattcatatttgaagaaatgtttatgccaagcggccttcgctgtcaaaagacaaaaaggcagcccattagcagaacgatattatcagattcaaagtcggcgtggctcacaaaaagcaaccattgcacttgcgcatcaactattaaaaatagcctatatccttttaaaagaacagatgacttatcctgaatttttagcacaaaaaaaaaagactactagggacgagctagtagcctaacataaaaaatttttcgctttgattatatcatagggagggagtttttgcattcttttgagttttcgtataagaactcgaccaagataaaaagagttcgtcttcccacccccgcacagttgattaggccagatttggagtgcaaaacacgaacaaatctgccaatcaaccactgcgctgagatgttgacacgaactctgagtagtggtcctgggctttttgcccagcctcactctattatttgctccatacggaacttttgtggtttcattccttggcgttcataaaaacggacagctcctgcattgtcagcccatacatccaaggtaagattgtggcaaccctgctccttagcataggaaagagcaaattcataaagctgctcgccaattctttgaccacgcgcagaattggctacacacaaatcatcaataaacaaggttttaattggttctaaaacatcgcctgttgcggtagataattcacaaaaaagatgcccaaccacttgtccctctaactcaaagacaaaaataggcttatctggattttccaaaagtgctactaattcagcctcagaaaatttttgacctgcacttttaaaaatatctggtcgtgcttggtgatgcacctgtaaaatatcttgaagcaattcatttaatatcggaatgtcagattgtctagctttacggattgtcataatactctccttttgagtttttattattatagcacatgttcattttttaacaaaataggtctacagaccgatgaagaatctgaaaattcgagtatactataggtgtatcctaaaatttttcataaatctcctaaaaaatcagctggccaaggctggttttttgttgtcttaaaacgagaatgtgtagtgtagaaaactactaaagtttctctctctttgacgcaaaatgcttttgcttcatttccaacctcccagagtcactcccctgactctgggagccccaaaacacagaaacatactaagattagtagtgaggaaatctccgacgggagaaagtactcactactttttctttatgataaagtagaggtgtcttgttaagtcgtagggctttttgacgctagacgtcgcaacaaaaactggcaagacacctgttttagaaagaatgttatcaaagtatgtgggacgccagacgtcgagtattgaaaatgacatcgctaaaacaaggaatcattcaagacaaagaggtaatatcatgcgagtagtttttgggattgatgtgagtaaggcaagttcagaagtggccattctagtcaatggtgagaaagttcatggctataccatatccaatgacgccatcggctttgctcggctacttggcgatttgagaaccgtccataagccagaaatcatctttgaagcaacaggtgtctattctcgccgtctccaaacttttctagatgataatggctatgcttatacacggcttaatcccttagaaactaagaagcaactggatagcttgcgtgtgcggaaaacagatcaaattgacgctgaaaaactggctcaatctcaatttgtgctgaatcgtaaacccacttatgtccaagaagaagtctaccaaaacttgcgggatctcagccgtttctatcagaatctgaccgaggatattgttcgagctaaaaaccgcctgcacagggtcttacaggtcactttccctgaattggaaaatatcttatcgacaccatctggcgaacaatactggaacttagttatagcttttccttgtaaggactgtgtacttgagttaagcaatgatgaactctcaaagagcatccgtctgtccacttcaaaacggatttctgacaagcgtgtggcttacttagccgagaagcttatagcactagctaatcaatcttattgtgccgtcaagaaaacctctccaatactggaagaggtccgttactatgcaaaagaattgcttagactttatgaacagagacaagctgtcttagacgaaatggtggaactagctcagccattacctgaatatgacattctgctctctattcctggaatagctgagactactgcaacaagtattattggtgaactgggagatattcgccgttttcagtctgccaaccaaatcaatgcctttatcggtattgacctgagacactatgaatctggtaacttcctcgctaaggaacacattaccaagcgtggcaatccctacgctagaaagattctgttcaagtgtatccacaatatcgcttcagccagtcataccaatccttgccatatcgcagacttttatgagaaacgaaaaagacaatcgcaaacgacttcaacgaagccgcacacgattgcctccatacatcgtctcattcggacaatgtattacctcattatgcataacaaactttacgattacgcttcaacccaaaatcggtaaaactgtttatgctctatcattgtaacaccttatcaaaaaatttcaacataaggtgttggttttgtatgcactttttacactaaaatgtagtccaaaataaaacaatttccttattttgactattgaactcaaaatatttttcgtcaaataccttgatggacttgacaaatagtagaaaaaaagcccgtcggacaagctagaaagcttgatatgacgggctttttgatgcttagcctcgctcttttgtttttaagcgagggataaaacagtctatccccagactgttttattttacagcgtctttaagtgctttaccagctttgaaagcaggtactttagatgctgcgattttgatttctgcacctgtttgagggttgcggcctgtacgtgctgaacgctcacgaacttcaaagttaccgaaaccgatcaattgtactttttcaccagctgcaaggtagtctgctactgctccgaatactgcatcaacagctgctgctgagtcttttttagtcaatgaagttgcttctgcaacttttgcaatcaaatcttgtttattagccatttgctaagtcctccaataattttctgagttattactcacttctatatagtaccgaattttaggcgtttggtcaagtttttaatgctattttactgtctttttctgtagatatcaacaatgaattggtcgttgtacaaatcaatcgtattcgcctttccatacagaccaaatttgttcttcagttctgtcagttgaacctgtacttgcgcttgttctgagtctatttttacaaaggcaggtagtttataatttttttgtaaataagctaatacctctgctttcggcaaggataaacttccaactgatatttctgttatccgtaacaaaatactgccatcttccattttgctaggttgaaaataaatatagagtgggatagtcacaccaaaaatctgatagctgccttcaaaaacaacttgctgactcgttacgaataattgataggaaaactcttccgtctgatactcttttagatagttagtgagggtttggttgagctgttccctattagtggagaaggtcccaacctttgtgtcttctgtactagtctgaacgagctttgttaaatcctctctatctgtttgaatccgtgtatagaggactattccgcaaccaatcaataaagacaactgggctaaaaataaccatttccaaatattaaggttcccagctttccgtggtctcattcattctctccaatatcgcttttttcataatctcatatccagtattattgggatggaaactgtcttcctcatacagtaaattattggtaacttggctaccattttgactaataccagcctccccttccaatcctttataaagcaaatcattgatcggaacaaagtagacatgctgatatttttcagttatctgttctgtcatcgtattccaattatcaacaattgtctgcatttctgtcaattcaggaaaattgaggtagagtggattgtaaatcccgacaacatagatgggaagatttggattattcttacgcgctgtcttaataattgtatccaattgttttccgtaatcttttgcgggcttatcaaaagttgaaactttgagattggcaatgtttttaataatagccttgcgcaaatcgttgccaccaactgtcagagttaacagatctgctgtttttaagtaacttatcagctctccatcttccttcattcgtttaagaatctgattactggtattcccagaaactccgaaatttttataatctacttcataaccataatcattagttagagattgagccaacaagggaacaaatcccccctgtccagttgtatctccaacaccttctgtcaaagaatcaccaagtgccacatatcgaaaactgattttttctgatacggtaagctcttgtctggagatgcgagatgaggcaacaggaatgagctgatgaaatagaaaaatcgaccctagaattgtcagaaaaaagaaaacaaagccttgaatcaacttcctattattcataacgaagcaaaatagcccaggcatcctcaccagtatgagtttgaatgatggaacctgtctctaaaacagaaatttcttttgagacgtactcttgtaattgactcttcatttcatttgcaaaatatgccgttcctgaataggaaataccaatctcggctacttttttatctgctagagttgccgtgaactcttccagccattttttaaaggtcttattgcctcgtcccttgacaatcggagtcagctgatggtctttcatttccatgatgacacggatattgagtaggctactcagcatcccttgaacacgtccaatacgaccacccttgactagattttctagggttgatacaccgatgtataattccgttttttctttgactgtttcaatagctgcaaggatttcttctttgctggcaccagcttgtgccatgcgtgctgcttctacaacttggaatttttcagcctgatctgtaaagcttgaatcgagtattgtcacatcagcaccagaaagggttgctccttgtctagcagcttctactgtccctgacaaggcatgcgacaagagaatggcaataatctgactgccgtctttagccaattcagcaaaagtttccgcaaagagtcctactgggggctggcttgtttttggcaagtttttcgacccacgcatgagctctaagaattctccttcttttaaatcgttgtcagagtatacgactccgtcaaccattacagataatggaacaactgttatattcaattcttcgaccaaactgggttcgatagtcgtacttgaatccgtaacaatcttaatctttgacatatttcatcctacaattctcttcaattttgccatctattataacaaattttaactaaaaaataaactttggacataagcaaaaaggctagtcgcctaacctttttctactaattcttttgcttgattacgggctgcatctgtgattttgtcaccggctaacatcttggcaatttcctcaatacgctcttctttggtcaagagacggacacgagaaacggtcgaatgttcgtcggatattttctcaataaagaactgataatctgcaatagcaatgacttgtggtagatgagaaatcgccaatacttgcccatattgtccgattttataaattttctgggcaatggcctgggccacacgtccagacacccctgtatccacctcgtcaaagacgatggaagtcttgccttctttacgggcaaaggctgacttaatggccaacatcaagcgagacaattctcctccagaagccactttaaccagaggcttgaagtcttcacctgggttggtagagatgtaaaattctactgtttcatttccttctcgattaaattttcctttagtaaatcgaacttggaaacgagctttctccatatacaagtcttgcaattcttggcggataatatcttctaaaacaacagccaattcatggcgtgattggctgagctgacctgctcgttcaaccaattctttctctaagttcttaagctgaacttccaaatcatctccagataaatcattgcctgtcaatagattgtattcttcgctgattttactaaaatagtccaaaacatcatcgacagttccaccatatttcttcgtaatggtattgagcaaatccagacgactttccaattgcatgagacgattgccgtcaaaatctagattatcgaccacatcgctgagacgcttggttatatcttcaacgacataataagcttctgtcaggctagaagagagctgtttgtagtctggatcaaattcttccagactttgcaagtcactcatagctgagcgtaggttgttcaagcttgaaaaatcttcattgtctaacagtgcataggcattggtcagtgtatctgcaatttgtttgtggttgagcagtttatcgcgttcctgattgagttgaatatcttccccagacttcaaatccgctgcttcgatttcagcaatttggtattctagcatctcaatccgcgccttgtgttcttgctcatttttttgcttttcaagaactcgtttgcgaagactacgataggcatcaaaggttgtctgataacggtctttaagactccaaaattcatcttctccgaaactgtccaaaagacggatatggtgctgggatttcatcaattcttcctggtcatgttgaccatgaatatctactaaatattgcccaatctgtttcaagacagataaattgaccatttgtccattgacacggctgaccgaacggccattttgcaggatttcacggcggataatgagttcgtcagctacttcaatcccctgttcaagcaaaatttgctcgagagctctgctattttcaaaggaaaagagcccttcaatctcagccttggcggccccatgtctgataacatctgtcgtcgcacgcgcccctagcatcaggttcatggcatcaatgataatggatttacctgcacctgtttcaccagataggatggtcatcccgttttcaaaattcagtgatacctgctcaataatggcgaagtttttaatggacacttctagtaacatggctaccaccctctaaccgtctgttcgatttgcgaaataataccttcgtttgtaacaatgagcagaatactgtcatcatcagcaatcactgaaaaaacatgttcttgaaattgttccaaaatctggcgtttgaccacagcagagcttccaggtaccagacggagattaatcattttatccatcactgagacttcaaaaacattctgcgattttaccttaacaagacctgcctttggtaaaccataaatatatcccttatctgctgatggaaccttaataatgccaagttccttgatatcacgtgaaaccgttgcttgtgtcgcattgacacccattgcttctagacgttcaacaatttcttcctgtgtatcaataggaaatcggactaccaaatctttaatgacttctaatcgttctcgtttattcatcctttttaaattcctcatgtgcttgatagactgtagttgttatgacctctttatcaatctggtttggttgtgttgatttttctaagtgcgctaaaaattcgatattgccatgaccgccttgaacaggggaaaagctaagggctttgactgagaagcctgtttccacggccatttttgtcacttcttccaagactttcaagtgaacggatttatccttaacaatgccatttttcccaatctgttcacgtccagcctcgaattggggtttgacaagggcaacaacctggccaccctccgctaaaatacgatggagtgctggcaaaatcagactcaatgagataaagctgacgtcaatggacgcaaaacttggttgaccaagttcgaaatctcccaactcagcatagcggaaattgtactgttccatgctgattacacgttcgtcctgacgtaatttccaagcgagttggttggtccctacatccacagcatagacctgcttggcaccagcctgcaacataacatccgtaaatccgcctgttgaagccccaatatcaatcgttgtttgaccctcaactgataagtggaaaacctgcaaggctttctccaatttgagaccaccacggctgacatacttgagtttttcccccttgagcttgagttcaattccctcgtcaatcttctcacctggtttatcgtagcgttccccgttaatgacggatataactaagccagccataacaccgcgtttggcctgctcccgcgtctcgaaaagcccctgtttaaaagctagtacatctactctttccttagccattgattcgtaaactttctatgatttctttgattttttctgttgaaaatgggacttgtttagccacttgatctagctcgttgattgcttgattcaagctatcttctagaaagacttttgaggcttccagtcccattagggcagggtaggtagacttctcagccaatacatctttttggggagtttttccgatttcctcaaaagtggctgtcacatccaaaatatcatcccgaacttgaaaggctagaccaattaattgacccgcttgtcgcaaatggttgattaccacatctgattgtcctgcaatcaaacctgctgctacaaagggaaatgtcaataattttccagtcttattggcatggatggcttgtaattgttctaaggtcaaattctgcccttcaccagccatatccaagacttgaccagcaaccattccaaaggtcccagatgcctgggaaagctctctcacgagagcaaggatggtctcagctggtaaatcaacttgggctaggaaaccaaatggatctagaaagagactgtcccctgctaaaatagccgttgcttcatcgtaaaccttgtggttggtcaagcgaccacgacggtaatcatcattatccatagcaggcaggtcatcgtgaatcaaacttcccgtatggatcaactcgacacatgctgccacttggtaatgagcttgttttaattccatcccaaaggactctaagatggtcaataaaagcaaggggcggattcgtttaccaccagcctgtagcgaataaagaaccgattggttgaggcgttcagctacctggggttggtaaaagtctgccatggcttcctcaagtcgctgcaatttactggcaaccattaatccatctccgcttcactgccatccgcctgcatgaccttgaccaaggtcttttcagcttctgctagtgtcttttgtaggtctttcgatagaaccattcctttttgaaactcggccagtgcttcttccagagccacatcgcctcgctccaatttggttacgattccttctaattcagctaagttttcttcaaatgttttcgtctgtttggacatgttttacctccacatcaagttgaccatccttcatctggatggttaggttttcacccatttgtacattttctacactatcgatcacccgaccatcttgacgaatcatggcgtagccacgggctacgatgcgactggtatccagcatagtcagggcctcaatcagcttgtccgccttggccatcttattgtcatagatattagccatattgctcttcaagagtcgttcctgctggataattctctcttggaaactttctactttacgacctggatgcacaccttgtaatcgttgctgtagtaggagacaagcctgtttctgctggctgtagagttctttcatccgtgtctgcaattgattggtcaagcggtctaatttttgcaaataaccatcatacaagcgttcaggctggcggaacatgactgactggctaattttctcaagctgacctcttaggaatctcaaacgattggtcatggcctgataggctctattttcctgctgattgaggtagcccagtaagtccgccttggtcacaggtgttgctaattctgcggcagctgttggggtagcagctcgtttatctgctacaaaatcagccaaggtcgtatctgtttcatgacctacgctggaaatgattggaatacgggattcaaaaatagcccgaaccacaatttcttcattgaaagcccaaaggtcttcgatagaaccaccgccacgaccaacaatcagaacatccaagtcatcccgttcattggctctttgaatattagtaacaacctcctgagcagcaccatctccttgcaccttggtcggatagagaacaatctctacgcctggaaaacgtcggctaacggttgtaataatatcctgaataacagctccactcggactggtaatgacaccgattttcttggtaaaccgtggcaaggcctgcttgaattcttctttaaataagccttcctgtgtcagagcttgtttgagctgttcaaacttgattgccaaggctccaataccatctggctcagctttttcaatgacaatagaataagaaccatttggttcatagagctgaatgcgcccaatgacattgattttcattccctcttcaagctcaaagcccagattcttatagacgcctgcccacatggtcacttggatgactgccttgtcatccttgagcgaaaaatattgatggctagggcgtttacggaagttggacacttgacctgtcaaatacaccttctccaaatacggatcgcggtcaaactttaattttaaatacttagttagatgactaaccgataaatattcaaccatgtccactccttctatattgtatccctactattataccaaattttgcacttttatacagaactaggcctattatttccgatagctttcctatgttttttttcaacaatttgctatataatagtttgtgagaaaataagaacttgttgacaggttctaaggagatttatatgaaaattgatgatttgcgaaaaagttctaacattgaggaccgcaggggacaatccagttctaactcatctttctcgtctggttcatctggcggaaatgttctattgggactaatcttttcacgacttggttggaaaggaaaactacttgttcttgtccttttagtagccttcggaggcatgtcaaaccttggtgggttgctttccccatcaacagggactaatccttaccaatcgagtcaagtcacaacgactggtacagatgtgtctgatgcagatgctgaattcatgagtaaggttttaggatcgacagaagatttttgggtccaagaatttaaagccaatggtttaacctacaatgcaccgactatggttttctatactaaccagacccaaaccggatgtggagttggttccgcccaagccggtccattctattgctctgctgaccgcaagatttatattgatacttctttctatcaagaattatctagcaagtataaggctgctggtgactttgccatggcctatgtcatcgctcatgaagttggtcaccatgttcagaatgaattagaagttcttggggcctaccatcaaaaacgggctcaactatccgataaggaaggcaatgcgctaaatgttcgtttagaattgcaagctgactattatgcaggagcctgggccaaatatgttgatggacaaggcatcttggatgctggtgatattgacgaagccatgaatgctgcccatgcagttggtgacgatactcttcaacaggaagcctacggccgtactgttccagacagttttacccacggcacttctgagcaaaggaaaaaatggtttaatctcggttatacctatggtgaccttgctcacgccaatacattctccgtagagaaaccgtaaacatccatagcctctcgtagcaataaagaaactcttgcaacatacacttttgcaagagtttctttataatatacaactgacaaaagccaatttacacatacggtaccacttttaaatatgaaaactgaatcatgtaaacttactcatcaactctaattagagcggtatcctagtttcaaacaatatcacaattattatttagcaaactttaattatttccagttatctctgctgcagactgcacagttccgtttggaataatcactgttttcaacaaattattttcctcgtgaatacgtctgtataagataaccatgtagactgggaataagatgagaaaactatatgttgcatgacacaataaagctaaaccgattaattctggtataatatttaggaaatagttaggatgctttacaacacgaaacaaccaatgatcaacaaaacgatgatcttttaccaacatgagcttaactgtccaaatatcacctaacaatcgtgttacccaaaataacattcccattgaaaacagcaagaatatcaaacctaagctactaagcgtatcaaacttggtgtgtcgcactactgcttcaaccaaacatgataaataaaatagaatatgtacaattgttaataatttagtattttgaacaccaaattctgaaccgccgtttttcaaaatccgtttttcgtttttaattgaaatcttcaaaaaatagattctcaccaaaaaaacacaaataaccaaaaaaacaatcataaatccctcctgtattttaacagattttatcaaacacatccattatacaaagttagactgtcgccattctattcctctcctgttttttttctattttccatttgagactacaataaaagagacctgttttcaaaaatggatgaaatcatgtctcttttatagtcttttagtttacttttagtaccagtcaacgagctgcagacagcttgtacagtcgagtgactgtgcaaggttggagatagcacttgcggagcaagtcacccctgcagagtacagcaaagcgagttcaaacaatccagtggagtgtttgaagttggaaataaggaaacggagtttcctcttacgtcgaagtaataaaagaaaaactaaatattgtctatattttacctatatcaattcattactattcgctgtactttgtgattgcaaatgaatcataaaacgcatagtttgtgtatcagaagcataaaaagtgtacggaaagccgtgtttttctaatattttctgtacaataaacaaaccaatccctatgccaccatctttcttatcacgactgtagtctggacgatagaatggacgaaagacttgatccaattcctcgtcacttaaaacacgttcaacctgattttcgattattaattgattttggcgtagtactacacgaataatagcctctttacatgagtaccgaaaggcattatctaaaatattcttaatagcttttaagaaataaacaggatttgcctcaatgagaaccggtgatagttctacttcaaattgatagcccttaacctctgccaaactctgataacttgttaaagaggaatcaatcaactgatctaatcggatttgttctctgctttcctttaaagccatatcaagatttgtcgcttctaaaatagaatgaactaactcagattgttcctgcaagatttccttgcatttttttaaatatgtatcatggtccttaaatggccccacattataaatcatgccttcgactaaccccaacatactagctattggagtttttaattcgtgtgatgtgatacggaggaaatcagacttctccttctcacgtgccatagcacgttcattttccgttcttaattcatcgatacttgacaataacttgctatacaggctgttaatatcctgagccaatattgttatttcatcagttcctgcaacagcacaactgattccagactctaacgattgcattcgtcttgttgtttctgaaattcttgctattctacgagtggacagtctactgtaaacaaaagctaccgaaactgccagaacaataatcaacagcaatatgaatggataaaaagttaccaatgtttgactgacatcagataacgagtgaaatccataattaaataacagataatatgtaactccttctgcagatgttatctcggctccccaagaaccaatttcatcaaaatccccattttctaaatactcgttctcatgctttttagccatttcatcattggggtctggataaataatttttctatcactcgaaaaaagactaataataatattcggagtttttatgtcgaaatcatcaatctcagatataatcttagcttctggcatcccatccaattgtttagccacagtcatataatcgtgtctcaattcctgtttcttaacctgattataatatataggcatagcataatacaataaccctaacaatgttacagagatgaaagaaatcatcgcagcaacaataataaaattttttctggcaatccccatattaagtaccctctatttgataaccacgaccaactattgtcttcaaaggaagtgacggcaatttcttacggatattcttgatatgattatctaagacacgactatccaattccgtatatccccatattcccatcatcaagttatcacgactaacaattttcccacgtcgtttagctaaatatagtaaaacttcatattcttttttcgtcaattgaacttcttcttcttccatataaactgccccgctagttggttgaataagaattgttcctatctcaatgctatctgtctctccttttcctctcaaaatattctcaatccgttttaccaatatagttggtgaaaatggtttaacaacataatcacttataatctgattaaaactaataagctgtgtatattcgtcacccatggctgtcagcatcaaaattggaatctgagaagttttgcgaatttccttcagtacttccaaacctgtcatagatggaatcatgatatctaaaacaattaaatcgaattgttcttcttgaaacctttctaaagcaacctttccatcaaaaacagattctacctgataaccatgttcttttaaaaactcacaaacaacttgactaataactatgtcatcctctacaaccaaaatccttgacatttttatacctcctcgtaaagttctattataaaatattattatacttcaattatataccgattcgtacaatggtgcaactctatcatagataaatagagcaccatgttctgctatttcagctttcttttgacttcttttgtttaaaacagataaaaaacagacgaaaccgagagcatatatagatttgtttgataaactgaactaaacaaaaatgaaaggaactatcccattatgtggagtccaaaaaaattaaccgtattaaaatggtttgatattctcattctaacaattattttatttggagatggaatcatcaactctactctccaatacatagccttacaaaatcaaactacaactcttcaagaaaatttgacattttcaacaatggataattataaggctttggctctacagttagtttggctcacaatagccatcttctatctattactccgaaattttgatttctcaatttggaaaaaacatatttttattactccttgggttccattacaagctgttgccttattcattttttctgcattatgcttggatatctataatctagtatcctatcagtttctagcttccaacactccatccatgtttcaactatttcctaacattgatttatcactgatcttgtactcattgttgaacggattttatgaagaaattttcttccttaacttgtgcttactggttaaccctaaatatgcaaaatgggcatttttatattcgttaattattcgatgtagtttccatacctatcaaggtttacttagtgcactcggtttaggcttaattctaggaactattttctatctactttatcaaaaaataaaacctaaaaatttattaccatttttcctagcacatgctgtggctgatgttatcggtttaactattctatcatatattctatactagttatctaacagataatttgaacacaagctatcctcatatcaccaaagactgagtggacccctactagtcatgaccacccgtgaaaacgggtggtttattttgtgtaatttaggaaaagagtgccaaaaaacgcataaaatcgtgttgctaagaacgttgattttatgcgttttattatatgacttatctcaatatttttattgaaatttatatttatgcccaactatacttctcagaatcaatgtccatatctcatctcagcctagtatagattgacagatttattctacattcccagttcagcctctgcagctattgcgaatggctcgttttatattcaatctccaaagatttcctaaaacttggatctgtacggagggtaaaacaattccatcactattataggcataatctctactctattaaccatatgtatatacaagtagaaattacacgaccaacatttacttcgattcttgcttacgttttgtacgataaagtacctgagctcctacaagaagagagagggcagttaacgtatagattggagaatcagcttgtccagtagatggaagcgagtttgacttctcggttgaacgattcacactagatactttctccacattgtcagaaagacgtgatttctgattcatagcaagctctacctgatttgccaccgtttcggcattcactttatccttgatagtagaaattggagcagagttatctgaatctttaatagtcttagaagaatctggagtatcactattttctgctttaccaatctcttcagttgactctggttccattgggcgagacaaatctggggtatccattacttttggaatatccaatttttgtgtacctgctgaactgtctgtatcttcgataggcttaggtgattctggtttaacactgttttctgtttcaccaatttctttaggtgactctgacttcattggaaaagtggaatttggaataataatattgtccgttgctttcggaattgttgagtctggtttatttgctgaatcatcggttgagtcttcgataatcttaggtgattctggttcaacattatttcctggtttttcggtctcttcagttgaatctggcttcattggaagagtgggatttggaataataatattgtccgttgttttcggagttgttgagtctggtttatttgctgaatcatcggttgagttttcgataggcttaggtgattctgtctcaacattattacctggttttccagtctctttaggtaactctggttgcattggaagagttgagtctggaacatttggttctgtctgtttaggcatttcaggtgtcaccataggtgtcatattttctacttttgatatacctgttgacttgtctaccaccttatctgtatcttttggctcaataggaacaggaaccaaaactttcttagtttcatggttaagagacacttttgaggatgagtattttgctgttttttctctatcattattaagagaataacgaacctcagttcttaccaattcttggaaacctttattctttttattttttttatgttgcaattgatatgttaaagatagtggcttgttagtttgataagccttgattaagtcttctttatctaagttccaagtaatagttgttttcgagttagagaaaaacgaccataataaactagatgtaccatttgtgatttttactttagaactatctggttttttcgcgaactcaacatcattttcaagcgaatctactaagctcactttagtcaatacatctttaaatttttctgcaacattctcgtcaatatttaaaaactcgcccttatccccagacatttttttcaagtagtcatcaaatttattcttttcttcgccagctttgtctttggtcacatcaacagcgtagaaatgaatccctttctcagtagcaatctttgcttctgcctgagcagagaggttatgattgtaaaagacattttttcgaccgtagaaaatgtaatcaacgagggaatttgcaaacaagtcaattgctttttcagaggtatttgtcaaaccaatctttttaccgatataactgagagtatttgtaggcaatgcagccttatctaattctttttttaaattatactttattttctttacaatagcgtctttaaatggtaatggatcaagtttacgttcataaaagctacggaaatggtacccctcaccaatttgtttctcataattgaatttttgttcttctaatttggagctatcaatatcagctaagtcaatatagtctaacgggtttctgaaaaactttccaataaagtcagttaaacctgcgacagtagatactccatctaatgcctcattaaaccttgtaattcccaatttattcaagaattcaatcaagctcttggcatcttttaacaaatttgctctgcggacagtcacatcaaatgtaaatggccaaggcaatagagggttagtatgcaccactttatcttcattgattgtcttatacttagtttctgttttcgcagcatccgtcaaatcataacaaaatgtagactccccttgtgacagaagtacaatatgtttgcgtttccctgatttctcgctttctaaaatgcgacgtgcttcatggattgctccctgcatatctacgccccaattgtaattttgttcagcatcagtgaaaagcttctcaaccgtgtcttctacagtaatactgttaacctcttgagcttcagataacttgcgattgaaaccgatcacacgcacagagttacgagaattatgattattggttgggtcagtcatttctttgacaagcttgacaatgttatctttagctgcttttttagcctcttcatccatttttttagatgtatccaccaagacaactatttctgcacccttatcaatttctttcggcacaatttgagttgttactgtgacaactccatcttgccctacttctgctgttcgagaaactgtaaaaagctctttaggagttttatccactgtactagatactgtttcatttggtttttcaaccttagtagaatagtcatctacttccttctccacatactgaacggctggttcttctttttctgttgcttttccttcagaagaactagtgttttcagcaacttgccccgttggctctgaagcgttttcattcgttaatgcctcaggagaagcagattctgcattcgattttggcaaggcagaaaatagaagaggagtcaaccacctctccttccttattttcattagcttggacaactttagggtcttcaacagcaataggacgtgtaatcgaagaagtattatctatctcctcatttttttctaaagtagtactttctgtaacaggcgtttctgcatatactgtcactgtattttgaggatagagtgttcccgataaagctacccccgctcccagcgaaacaagtccaattgatagcttccgcaaagtgaattttggatgattcattatgattccttctccttgttctctataaatttagaatgtattttcgcccttctttaggtattttcaaaaaaggaagtatggatgtcaatggtaaataactttagtatcattttgttcaagaagcgtagagcttttgggaaaagaatgggcaccttgtgtattcataaggtgcctaagtccttctgttaactgcttacttcacctatcaagtcaagcaagcatgattacaactcaaagttcctatttatcattaacaatgaccatatcacaaaatgtgcgagtctattactacataattcattctaccatataatttaaaaacagaatttgttttttctctatcgtttgtttatgtttattctattacaaaaatgataattggtctttgagtctgttatcacacacatttatacaagtgataaatattgcaatgagtcttcaaactctactttcacctctataagcaaataattcattgaaagaaaaattttaactcttttaatttaaagctacacaatgcctctcatctgtcgcaaacgaatttttgagagagctttgtcatcgccttttactcactttctgttatctttttcttgccaatgaataaagcaaataagaataatatgatcgataacattatattggcaaccaagctcgttttttcaccggtcttaggcaggctttgaacttgggtattctcaccactatcatgcacagatacgtttccttttgtccctttgtctcttacagtacgagccattttctcttgcttagtaggcatatcttttttcgaatcatcaaaaatagaaaccgtttcttcttttgatggctctgcattttgctctacttttttgtcagtcagcgtttggcgtacaggtggcaaagtagtttgctcaagtgtgtttgattgttcgatatttttggtaatttctttgctaggttgctcttccttctcgtcctttttatctggtttattaatgcggtgaccatttcctttttgaaccgttacgacttcccaagctacctgttcaccttctttatcaaacgctctaaacgataaggtttctccattttttaaaacacgactacccaaatcaaattcgaatcgacctgttgaatcagttgaagttttaccaattatctcctcgccattctgagttgatactagttcaatcattacatctggagctgttttgccactgatgtaaccatgatctgtagtgactttttctacttgaaatggtaaatccatcacgtcttcatcttccaaatattgccctacaacttcttccttactagcgatgatattatttgtaaccgggtcaatgatttcaaagcgaattctctcacctttttcaaaaggcaattgtaaatcttgaatttggaaaccaaaaaatcctaattcgtccacttgaactggaggatactgttttcctttgattgacgaaaccatgcgaacgtaggcattaagatgtatcgttcgaccgacaatataatcttttttattatgcagtttaggtacaatgataggatcttcatctgtcgcttcatccatatctgcatcttgtaaataagttgctaaagatgccataacagatttatccaataatatacttgaaccatcaactgtatcaagatggacagataccaagtcctcttgttgattgtgagtcaatctgtagtacttatcctcggattgtagggcaggcaaagcaatcttatagtgacctgtctcatcagcaatagcttccatgataaactctgaagtatcagcattgtatagatgcacacgacctaaaggaaatgtagttccttccaaaactgaagtcgcacttgataaaggttttactgtcatttgtgaagatactttttcttttaccaatggttttacaatagtattagtaatcaccggctgaccatcttctgatacaaaagacaaaaccaatctatcatctgctttaaattttgaacctgctaaactctcggaaaaagtaacctcaaaccgtccatctttaggatcaattagtgtcttatcagagacaaaactaccatttattgatagatagactgaacctttgacagaggtatgaccaataactttgctcgtatgttcaaaaactggttcgatgaacacttgatgcattccattagatgttttttctaatctttttgctggaatttcataagcctctggatgtcgattagtcctcactactaccttacgctcttcagaatctgcctctagagtccaaaactgtttcggcaaagcactaatttccacagtttggctgtgagcaagtggtttactcaaccgataagaaaaatctcccttatcatctgcttccaaaatattctcaatagaagtaattgcttccccatctatcgtaatcgctacatatccaccaggagtggtattccctgagatggtttgatctccagcttgaatcggagcaacctctagatggttttcaataaatgaaagttcttcctccatatcctccatctcttccgattttttttcttcactcggtacctcatcagtcacttcctcagcttcagcattttccgaaactgtattggtaagcgatgattccgtgctttctaattgagtttcaagagctgtagcgtcagtctcctcagccattgcggtttccatattcatccctgtaccaatccatagaaaagcaattgccaccgaaactaaacccatcttactttttctcaacgaaaaaatcttgctattcatcttttctccttatatctgtattaacaattaacgacacatattgtcctagttttattataaaaaaaacatctcatagaacattgtttttcattagttttttatctgtttcacagttgtctgtaataaatagcatgctacatttcgcaaaaactttgctggttctcatagtcatttagtttttcttttattacttgtaaatacaatttctaagttatggcacattcaaagtaaagaacaagcgcctgaatttttctatgatgcagatcattgtttttatctcggagtgctcgctttaattcgtcaacttatactcaatgaaaatcaaactaggcgatgcatatgcagatagaactgaagtttatcaaatcaagtcaacaatgtctgattttgattttcgaagagtattaaataggagtgggtttatttgtcatgatgccacttgtttattttgttaactatcacttcataaaacatgattgtcctcacaataaaaaaagcacccgaaggtgctaggtaagatcatcctaccgacttcacgttgaggtaggtagaaaaattcattaggcgttgaaagcgtcagtcaactgtggcaccacttgtttcttacgtgaaacggcacctgcaaggaaggcgtggttgttttccaacttgaagttgaaggctgcttctaccttgtccatgttgctaccgagcgcaaggatttctgagtttgagttaacgatgtctgtaatcatcaaaacaaagtcagagtagccatttgctactgatgctgctgtcatagctgcttcgatttctgcttggcgttccaagacttccgcaatgtccactgtgttaacttgggctacacgcacgtcattgccattcaagccaaatgttttggcatcgatgtcaatcaattcttctgctgacttgctggcaaggttggtaccagctttcaagagtgccaaaccgtattcttctaagttgacaccagcaatttcagccaattcagctgctacctgtggatctgttacatgagtagttggcgatttaagcaagagggtatctgaaatcaaacctgataggagaagtccagctacttcttttggaggtattactccgttttctttaaaggcacggtaaacgattgatgatgctgaacctactggctccaaacgcatgtacaatggatttgccgtttcaaagtttgcgacacggtggtggtcaatgacagctgccacttccacttccttgatgtctgcgatagactgttggaattcattgtggtcagtcaagatgacttggctaacaccttctgcttttgcagactcaaccacgcgcggtgcagtaacaccaaaatagtcaagagcaaaagcagtttcttcatttggcgttcctagaactactgcttccgcatcacgaccaaacacttcacgctccaagtgagcccagccgtatgatgatgcaatggcatctgtatcaggattttggtgaccaaaaactaaaaatttagacatgtctacaacctcattttttctaataatctcctacattttaccataaatagaaagacttgtgaacatggacgggtcgggatttgccaaacgttttcaaaaagagtaagatagaaggtagcaatacaaaaggagaaacatatgaaattttcagactatacctatgtccgtccagattatgaagctatcaaggctcaatttactgacctgaccgaccagttggctcaggcaagtgacttggaaacaactcgcacacttgtggcagccgttaccaaattactcaacctggtcgatacccagtacaatctctggatgatccgtcatactattgacatgaacgatgagttctacaatgaagaaaccaagttttggaatgaatattcgccactttttgaagaattgaccaccaactactaccgtatcattgtccagacgccgtacaaggaagaactgtcagacatcttgcctcaaaccttcttcatgcaggcagaaaacaagctcaagaccttctcatcagacgtcattccattattgcaaaaagaaaatgaattgaccgatgagtacagcaagctgattgctggtgcagagattgatttccaaggtcagacctacaacttgtcacaaatggggccattcggtcaatcaaccgaccgtgaagtccgcaaggctgcttctgctgccacaactaccttctttgaaagcaaggaagctgattttgaccgtgtttacgatgaattagtaaaagtccgcacagaaatcgcccacaaacttggcttcaaggactatgtggaatacggctacctcaagatgaaccgtttcgattacaatcgtgacatggttaaggtttaccgtgaagaaatcctcaagcatatcgtaccgattgtacaaaatctgcgtcaacgccaagccaatcgcttgcaggtgccaagcctcaaacactacgacctaaaccttgagttcttggatggaaatgctgttcctcaaggtgaccccgactttatcgtcagccaagcccaagacatgtaccgcgaattgtccgcagaaacaggcgagttcttcgatttcatgattgagcatgaactcttggacttggtcgcaaaaccaggcaaaaacagcggtggctactgtacctatatccctgacttcaagagcccattcatcttctccaacttcaacggaaccagcggtgatattgatgtcttgacccacgaagcaggtcacgccttccaagtctatcgttcgcgttggattcaaagtccagaagttgtttggccaacctacgaaacctgtgaaatccactccatgtctatggaatttatgacctggccatggatggaccgtttcttcaaggaacaagtggataaatataaatttactcacttggcaagtgcccttctcttcttgccttacggtgtcttggtagaccacttccagcacgaagtctatgaacgcccagagatgacaccagcagaacgcaaggcaacttggaaaaaactccaagacctctacttgccagaccgtgactattccgagtcagaagccctcaaccgcggtatcttctggtatcgtcaaggtcatatctttgctagtccattctactacatcgactataccttggcccaagtttgtgccctccaattctggaaacgtacacaggtagatcacgatgaaaatgcttgggaagactacatccgcatctgtgatttgggcggcaccaagtccttcttgcaagtggttgaagccgcaaacctccaatcaccgttcaaagaaggtgcccttgaaagcacagctaaagctgctgctgattggttaaatacagttaaggatagcgacttataaaacacaaaaatctgaatgaatcaaatgactcattcagattttttgattatatgatacttgtccctaacacattaaatctttttcgcatcaatctccgacctcttcactattatcccttaattctattcaagtactcctgataggtctctgtctccatcaaggcctttgcattttccactcgagccttcgttgggggcttggtcccctctagtggatagggtctgcccaactcacgccacttaaattcaccaagattgtgataaggtagcacctcaaaacgttcgacattttttaaggttttaacaaacttaccaagttcaatcaagtcctcatctcggtcagtcaaatttggtaccaggacatgacgaatccaaacaggcttaccaatgtctgatagatattgagcacattctaaaatagtcttgttactgtgacctgtcacaatgcggtgttgctcaggattcatttccttaatatcaaggagcaccaaatctgttacttccataagccgactatatttttccaagtaacgctctgtcttacggaaagtcaacgcacaggtatccaaagtagtgtgaatccctttttcttttgcaagggtaaacagagcaattaaaaaatcaatctggatggttgcttcaccacctgaaacggtaatccccccttcttttccccaaaacatacgaaaacgcagagcttcattcaagacatcttccgccgttctctcagtcgctgctggattgaccagatcccaagtatctgggttatggcaatactggcaacgcatgtgacagccctgcataaagactacaaaacgtacccctgggccatcaaccgaaccaaaactctctgttgaatgaaccaaacctgtcactttacgataatcaatttctgtcatcatctcatcctcatcattttataagactagtatatcacaaaaatgaaaacgcttctatcatttactttctttctttcataaccatcatcttccgcaagaaaaaagctaaaagactaggttgccctagtccttatcggtttcttctttctccagtggtgtaatcaagagttttaattttgttacgcgaccattttttaccttatcgttaataagaactaggtggtgatctttactatctacttcaaaggaaactttctcatcttggctcggaatggtaccgactcctgtcagataataaccagcaatcgtatcaacgttatcactttccaactccatctcaaaatgctcattgaagtcattcaaggtcatatttccttggacgatataggtgttgtcagcaatttctcgaacaaaaatttctgtcttatcggtctcatcatcgatttccccaacaatttcttccagcaaatcttccaaggtaacgagacctgcaactccaccatactcatctaacaagatggccatttgattttgggtatttctcaatgatgtcaacaaatcatccacgaaaatcgtttctggaacgaagagaggctcctgcataatgcggcggatgttgagattgtcaaagccattactgaaagcttctgacaagattttcttggtatgaatcagaccaatgatattgtccttatcgccatcataaacagggatacgtgaaaaattctgcttgaggatagctgccatgatggttgctgtatcatcctcaatatccaccatgaaagcatccgtacggggaaccattacttcacgtgccatcagctcatctaaagagaacacaccttgaagcatttcgatttcttcggcatctaaggttttctcactctttgtcaaaatatattcaatttcatcccgtgtcatttgctcatccgcatcatcaaaattcataggagtaatacggctgataagattcgttgcagctgataataaccacacgaacggactaacaatttttccaaggaaaataatcactggtgcagtgactactgccagattttccttcatattcatggcaatccgcttaggatacaattcgccaagaacgattgaaacgaaggtcaacatagccagtgcaagccagtaaccagcagtttgagctgttgttgaattccccatccatttggcaaatacagctcctaaatcattagccaagctggcacctgaaaggatggagatgaaggtaataccgacctgaatggttgatagaaaattgttaggattctctaaaacttgaagcaagcgaatatatttcctctcaccgtctgctgccttttgttctactcttgaacgattgagggatacaagggccatttctgaggctgaaaagaaggcattgaacagagtcaataagaataaaattaacagttgtaaatagatggtctgactaccagggtcttccatgatgttctcctataataaaatttataacatttccattataccacaaattctaaaaattaacatatttcttgttataattagtccctcatatctgtttatgttacaataatcaaaaggaataggagagcaactatgattatttcgatgaagaatgtccactataaacgacaaggtaaaactattttagaagacatcaactgggaatttagaaaaggagagcgttgggctattttagggctcaatggggctggaaagtcaaccctccttcgtattttaatggctgagttttggaagacctctggtgacctgactgttctgggggtggaatttggtaaaggagatattcctagtctacgcaccaagattggggtagttggctcctttttggcagagcgttttccaatcgatttgacggctgagcagattgtcttgacaggaaaatataaatcctccatcctctatcgtgaatacggtcaagctgaattggatgaagccatagacatgctcaaaaccattaaggctgagcacttgatcggtcgggcctatgctagtttgtcacaaggagaacgccaactcctgctgattgcccgaagtttgatggaagagccggctattttgattttagacgaagcaactgtcggtttggacctcctagctcgcgagcgcctgctccaccacattgactacctctgtcaactcccaacggctcctgccattatctacgtcacccatcacgccgaggaaatcactgataatttcacccatgtcctcctgctcaaagatggcatggtcttggcacagggacccaaagaagatatcctgacacctgaactcctcagcgatttttatggaaatcaggtggaattgattgacttgggtgagggaagattgttcattaagccgatattataaaaaacaaatccagctctagttcgagctggattttaatcgttccaccatgaccaaaaatggtggggtattaacttggttgagcggtttgtagagcatggctgtaaagacggtttggtcaagctggctgataaagtctaaaactgcatccttctcaagagctccaccctcgtgaccatagtaaatcatgatagccaagcgacctccaaccaccaatctattcaggactttctcaatggcttgaagggtggttgcaggcagggtaatgactgacttgtccgccgaaggtagataacccagattgaaaatcgctgccttgcattcatccacatactggtctaggttttcgtgtcctgtcaaaaccaattgggcattggtcaagccagctttttctagtttttcagccgttgtagtcagggcttgttcctgaatatcaaaggccacaacttttcctgctcgttgggctaaaaatagcgtgtcatggccatttcccatagtcgcatcgaccgctaggtcctggtctgttaatatttcatctaaaaaggcatgggccatgtgtaaaggtctaagcatactttctcctaattatcgtcaatacataaaatctatcacatctagtatagcatactttccatcttcaaaaaattttttaaaaatcttccatttttcctattccttttgcgaataaataggtatgaagacaattatcctatttttccttggagcttctatcggctccttcttgggattggtcatcgaccgtttccctgaacagtccattatcgccccctctagtcactgcaatgcctgcaaacgacggctcaaggcctgggacttaattccagtcctatcccagctttcgacaaaatccaaatgccgttactgcaaggcgaagataccttattggtatctgggattggaattcttagccggtctagttgtcctgctctgccattttcaagtcctaaacctaaccgaaaccattctcatcttggcaggactagttttgaccatttacgacatcaagcatcaggaatatccttttgctgtctggctcatttttacttttatagctctgatactctcccagctcaactggcttttctgtggctttttactcttggcctatctgactgaaaaatggcaaatcaatattggttctggtgactttctctatctggcaagtttggccttaatatgtggatttacagaactcctctggattatccagattagttccctcctagggcttcttgtcttcgccattttcaaacccaagtctattccctacgtaccactcctatttctttcaagtattcctatcattctgtgcacctaaatcgagtttttctcgatttttttgttataatagaaggcatattagagttcaactccatcaaaataattggagcaccttcttgataggaaggcaaaaggagaaacgttatgacactatttaaggatgacagtttaaccctgcataccgacctttatcaaatcaacatgatgcaggtctattttgaccaaaacatccacaataaacacgctgtattcgaagtctatttccgttcacaaccttttaaaaatggctacgctgtatttgccggtttggaacgcgttgtaaactacctcaacaatctcagctttagccagacagacattgactatctgacagaactaggttatccgaaggatttccttgattacttgtcccaattggaaatgactctcactgtccgttcggctaaggagggcgacctggtctacgctaacgaacccattctgcaaatcgaaggaccattggcacaatgccaactaatcgaaactgccctcttaaacattgtcaactaccaaaccctaattgccacaaaagctcgccgtatcaaggctgtcattgaagatgagcccttgatggaatttggcactcgccgtgcccaagaaatggatgctgctatctggggtacacgggcagcctttattggtggagcatctgcgacttccaatgttcgagctggcaaaatcttcggcatccctgtcgctggtacccatgcccacgccttggttcaaacatacggagatgattacaaggctttcaaagcctacgctgaaacccatcatgactgtgtcttcctcgttgatacctatgatacgcttcgtattggtgttccagcagccatcaaggttgccaaagaaatgggagataagattaacttcaaaggggttcggattgattcaggcgatatggcctatatttctaagaaagttcgtcagcaattagatgatgcaggttttacagatgcgaagatttacgcatctaatgacctcgatgaaaataccatcctcaacctcaaaatgcaaaaggcaaaaattgatgtctggggagttggtaccaaactcatcaccgcctacgaccaaccagctctgggcgctgtctacaagattgtatccatcgaagatgaagatggaaatatgcgtgacaccatcaagctgtcttctaatgcggaaaaagtctccactcctggtaagaaacaggtttggcgcatcacctccaaagaaaaaggaaaatcagaaggggactacatcacctttgcggacactgacgtcacacagatggataatatctatatgttccatccaacttacacctatatcaataaaaccatcgagaactttgatgcccgtcctctcctagttcctattttcgaaaaaggaaaacaggtctatgaacttccaagcctagcggaaattcaaacctatgccaatcaagaatttgataaactctgggatgaatacaaacgcgtgctcaacccacagctctatccagtcgacttggcacaagatgtttgggataataagatgaacctcatcaatcgtattcgcaaacaaactcagaccaaatccatctaagaaaggtatgttatgaccctacaggaaacaatcatcaaagaattaggcgtcaagccaagcattgaccccaaagaagaaatccgtcgctccatcgactttctcaaagactatctgaaaaaacacccatttttgaaaacctacgtcttggggatttctggtggacaagattcgaccttggctggtcgtttggcccagctgactatggaagaaatgcgggcggaaacaggtgacgattcttatcaatttatcgctatccgcctgccttacggtgtgcaagctgatgagtctgacgcccaagcagccctagcctttattcaaccagatgtcagcttaaccatcaacatcaaggaatcaacagatgccatggtggctgcagtcaatgcaaatgggcttgctatgtctgattttaataagggaaatgctaaagcccgcatgcgcatgattgcccaatacgctatcgctggagaacgcaagggggctgttattggaaccgatcatgccgctgaaaatatcactggtttctttaccaagcacggtgatggaggtgcagatatcctgcccctcttccgccttaacaagcgtcaaggtaagcaacttctagctgctttgggagcagatgaaaaactctacctcaaagttcctactgcagacttggaagaagacaaaccaggccttgctgacgaagtcgcacttggtgttacctataaccaaatcgacgactatctcgaaggtaaaaccatcgaccctcaatcccaaaccattatcgaaggatggtggaacaaaacagcccataaacgccacctgccaattactatttttgatgatttttggaaataatactcctcgaaaatcaaaatcagacgttattgacttgatttgatgactgaaaagctcctgtggaggttttcagcctgttcccttgaaatataaaaggaacagagttctaacatcaacttgaaggcgcaaacaatgttcgctatatttcctagcttcaactatctcccagatagttttgatgcgaaacatgttcgctatatttccaaccttcaactatctcccagatagttgaagctaggctacttttgattttcatcgaataataaaaaatggagccctgacagttgaaccgtcaggggttttgttttttattataacttcaaaccataatgaaaaaagcccacgcaggaaaaaatatcctgcgtgggcgtcaatggacacggtgccacctcactatggactcgactagaaaagtccataactttttctcctctaacaaggaggcgcacgataaggggtgcggaccgaactctcattgtttcgaattcatcgaaccaaactcactttactaaaccagacaatccataaaatggatacgaatgcttgtttggcatcagcctatctcataaacctctatcatctattcacaccaaccatagactctctaaagacaaagtgtttattacattttctgattacttgtaattatacgttacaaaatcaaaatggtcaagtgatttttagaaattttctaaacaatttgaaaattcagtttccattgcctgaatccattaaaaactaacaaaaagccactctgcttaagtgactttctaaaaaactgtactcacgaggctgggctcaagcccagcaccgcttctcaaagttagtgtcaccatctcagcgcagtggttgattgggtttaacagtccagtggagtgaaacagttcggggaactgtttcagcccgatcctagaaagggaaaagcgaggttaaaggttggagataagatttgcgaagcaaatctcagcaattcatgttttacactccaaatctgacctctacgactgatgcgaactttgttcgctatatctccagcctccaaaggttccccgaaccttcggagctatgcggaggtgggagtgaaacaatttgaggaactgtttcagctggtcaccttaaaactagaaagtgaccatagaagccgaacctaaatgtctttcccactcccatatcaaagatagctttagctagtcaaggtcatttttaagggaatactgactgtatttcaaaaaaataacgatatgtagcttaaacaatagcattagatggacattctgaacctgtgacggtaggttctaagactcctgtttggaaaggattatccctctctttatcaatgaatagctaaaataggctagtattccccccattgtattggtccataaatcatcgatttcaaagacgcgttgggcatcaatcagcaaatccagtagtaattgtgtgcattcaataaaaagactgatacaaaaactataacgaatcaccgctcgaaggctccgccattcttccctaagaaacaaaagaagaaaaatcagagggaaaagtagaaaaatgttagtgatgttttgcaagaaaatccaccctaggtccgccaaactatctaccttgtccccgttgacgatgctgttgaaaggagttggtaaaagatagagacggccaatttgaataattcctggggtcgagaaatccttatactgtgggtaccaagtctgtggtaggaaacaaagtaaaacaatagccagagcataggctccagctaaggtcttacaaatctgtcttcccagcttggtcaggttcccatctgcttggaagaattttctcatgctcgaatacctgcctttgcttttgcggctgcaatacgagcacgggctttttcacggtctttcttgagcgtattggagcgcaattgaccacaggcagcatcaatatctgtaccatgttcctgacgaacgacacagttaacaccatttttcttcaaaacatcaaagaaagcaagagtacgttccttggttgaacgactgtactggtcatgttcactaactgggttataaggaatcaagttgatataagacaatttacggatattcttagtcaagtcagccaattcctgtgcctgttccactccatcgttgacctcattgagcataatatactcaaaagtcacacggcggttggtcactttgatatagtcttcgattgcttcaaaaagaacttctatagggaatttgcgattaatgcgcataatgctcgaacgaaggtcattatttggcgcatgtagagatactgccaagtttacttggacaccttcacgtgcaaactctcgaattttcggtgctaaacctgacgtagaaacagtgatgtgacgggcaccaattgccaagcccttgtcgtcattaaccactcgcaagaaggtcataacattatcgtagttatcaagcggctcaccaatccccatcacaacgatatggctaacacgctcattctgattgcgctcatccaagtacttttgtaccaacataatctgagccacaatctcaccgctagtcaagtcacgttgcttaggaatcaatccagatgcacagaatgtacagccgatattacagccaacttgtgtcgttacacaaacagaaaggccatagtgctggtgcatgagaactgtctcaatcaacatgccatctggcagttcaaaaaggtatttgatagtaccgtccttagactcctgtacaatccgttgtttgagcggattaactacaaaatgttcttccaacttttcaatcaaagattttggcaagttggtcatttccgcaaaagattggacacgagaacggtagagccattcccaaatttgagtggcacggaacttcttctctccgttttctaaaatccaatcaaccagattggcttgactaaatgcataaattgatggtttcatatttctccctatttctggcggataacaaagttacgcttcacttcattcatctcacgcttgctttgtttacgctcacgtttttgagaacgctccgtttgactcgccttaacaccagcattcttcatagtaaaatgacgctgttccgactgtttgttttgctgcttcccctttttctgacggtcattgcgattacttttgttttcttttggcgcaataggctccgtccgcggctgatttctgttccgattgcgagaacgactccgcttccgacgcggtctattctcctcctcagcaggcaagtcttgtggattcggattggctaagacgaaataagcacaaccaaaattacaatactccgtcaaatagtcgtctaagcggctgatttttaagtctgatttaacatttttatcgtctgtatagaatccccttaatctcagctgctcattgccccaatctcccacaatataatcaaatttgagcatgagttgtgaaaaacgttgaccaaaaatcgtctgatcaaaagcattcttgtaatcttccaaaaggtccaattcaatattttcagatacaaccttatctccgacacgagcaaaactcggaccagggtatttattatagttatacatttcaggtgaaatttcttttttcatttgtcctcctatcttataaaatcttcatacgtaaaaatcatttgattaataatctatctggtcagaatctaaattctcacacttaaccttatcattataacacgatttatctggaaattcttctactttaccatttaggagaaatttctgacaattataatattattctctagcaaaaaaggacgatttactcgccctttgttttcttcaaataatcaatagcctcttgaacagttttcacaggaactacctcaatatctagacctgctttctcggctgcttccttagcttcttcatagttcgttttagcctttggatttttcttcaaaacttctacatcaactggattgtttggtacaaaaaagatacttgcaccagacttagctgccgaaatgaccttcttatcagccccaccaatgtcacctacttttccatcctgctcgatagtccccgtaccagcaataatccgaccatcacgtaagtcaggctctgcgagttgagtatagatggcaagtgtaaacatcagaccagcacttggaccaccaatatctcctgtttggaaatcaatcggaatcgaactttgaacctctgtatgatctacgagagtgatacctatcccgtttttgccattagacaatttgataatcttaccgtccgcagatttttcctgaccagcgctaatataaccaactgttacatcacttccaacctccaagccactcacatatttaatcaaatcaggagaagactcaaatgtttttccattgatactcacaacagtgtcggcaatattaagaacttttttaaaggttgaatcatccgtcaaggcaagcacatagacaccaaagaaatcaagattgacttcttttcctgccaaggtcaaaccttggtacttcgccatattttgcgatgtctccatgtaaaaccgtgctatacggaaatactcctcattgtcggcccctcctgtcatctcttcagaggaacgaactgtcgtatagggatcaaactgagcagcgaatagttgtaaagctgtagcctgttggactgatacataggtgaagttgtaagagccatcctcttggtctatttgattgttcaccgttagtacctgacgaatatcggcagctccacctggactttccagataataaggcagacgaacaaaaacggcaaaccaaatcaaaagagttcctaaaacaatagatgcaattaaggttaacttcctatttttcttcattctttctaatctcctcactaacaatttctggaacataagggcctatatcctgtttgaaatacagcaattctctaacctggctggatgatacgaacttaagctctggcttggcgattaaataaatagtttccaaacctggcgccaactgacgattgtaaaaatcaaaacttgactcgtattccaaatcggtcgcattacgcaatcctcggaccaaatgtgttactccatagcgcttagctacatcgactaccaattcattttcagacagaacgacctcgatattctccattcctacaaaaagcttctccaaaatggcttttctctccaaacctgtcaagagtcctgcctttttaggattggtaaaaactcccacatataatttatcaaatagtccactcgctcgttcaattaagtccaagtgtccattggtaatggggtcaaatgagcccgtaaacaatccaatcttatctgacatatactgttaccttactaattccgtagagtttctctttccatatccccagctctgctatttcctccggaagagagaccgccttatccgtttcgcagactaccataacatcatctgctagtaagtcacgccgacaaagttctgttatcacatcttcaatttcctgctctgcataaggagggtccaagaataccaggtcgaaaggacctcccacactgttcaaagcctgtctagcttccattgctagaagctgaaatttatctgcttccttagtcattgcaatattttcacggataatggcttgtgctcgtcgatctcgctcaaccagaactgctgactccatgccacgagatatagcctcgatagataaaccaccactgccggcgtacaagtcaagaactctaccaccctcaaaatagggaccaatcatattgaacatggctccacggaccttatccgatgtcggtctggttgtttttccatctaacgttttcagtggtcttccaccatagcttcccgatacaattctcataaggtatattatagcaaaaaatgaagctcgttgctgaaaccaagtgcacttcctgctttcctttttgcaccaactttttcaaccttctaccaaatacactctcaaccgctatagcaggaaattattctcgcactattcaacaaaatgataaaaataaaaagcaaggaaattctgttttacgcgaaattcctcactcttatcgtatgtatttaaactagatcgttacaagaaaaaattgatgttgaaatacaaatagctattttttccagtatgctaatacgccataaagaaccagtagctaaaaagtctacggattatctggtgaactctcgtcagctgttggaactgtttctactgactcaaccaggctagttgttgaatccgtcgtttccgccggggcttcagaaactgttggagtttctaccacaggtgctccttcactagtcggaggcactgaagtacttgtactagttgacgccacgctgcttgtatactggcttgttgaactcacactttgatttccatatatattttgattaggcactacataggattcttgtgaggtctcactagcttcagcaaggtccgttgactgactagtccctgtttcagatacttttttctcatcagctactttttgggctgcttccgctctgaccaactccgcttttagcttagcctgtgtttgagcatctgtctgctgtcccactagctcttttacttggtcaatccgtttctgtaatgctgcttttttagtcgcatccgtaaccttgtttactgcagattgtgcctctgcaagtttctcttcagtatgtgttccttctaatacaatgacagcattctcagcatcctgaaataatgtatcaaccgtttttttctgattggacacttgctgtactgtctttgtatcacttgtttcgctttgagcatttttataccaactagcgcctaagctaatcaataaaataagtcccataaaagaaataatgccaatttctgccaatgacaacttttcaaatttcttttccatattttttcccttatccgtcttattgcataagaaaatactctagcctactgacaatgctacttagttgtttttaccttaccattccatccgtttagaccatagcttaaaatatagatttcgttaaagccctgtttcttcagatgaagggctgcaggcgttaccaactgaccacgatcattctcatagattaagacaggtctgtccttacgcaaagcagctgtagactggcgcaattgctggtaaggaatatttctcgcacctaagatatgcttacgattaaactcactcgggtctcgcaggtcaatcaactgacctccgtgtatcttttctgcaaattctgcattatcaatcacagtcgctgcacgacgcaatctccagtaattaaagcccatccaggctcccaatactgccaaaaatactaaaaatacccaaaatgtttccatcactcattctcccttgatttctgatactctaattccaaacgatgttcacgcctcaaaacaagctctgcttccatatattccaaccgatctaagacacctgcctgatagattctatttaattctatctgcatcatttcaatatcgtagagacggttgcccatatagacaattataccaaaccgtttgagtaattgttgcacatcataaagtcttttcataaaaaaattgtagcagaattttaggtgtttttcaatataatactcaatgaaaatcaaaaacagactagctccaaaggtttggggaacctttagaggttggagatagagcgaacgtagttcgttactacttacgcagatagaaccctgttactattttgtttcaagggaacaggctgaaaggctccactggagccttttactcatcaaatcaagtcaacaacgtctgattttgattttcgaagagtataaaaactcagtcaaaaatcaggtctataaaaagattggacaaatgcccaatctcattcgtttatactaaccaacccttttcctgtgccaccttaacagcggcggtgcggttttcggcgcctagcttggacaggatagaggtcatgtagttgcggactgtcccgtcagacaggtggagctggcaggcaatttccttattggacagcccctctgccaccagcttgagtagttgactttctaggttggtcaaagggctgcgttgggttaagagaatatccatcaactctggcgaatactccttccgccctgccaagaccgtctcaatggtccgcatgaggtctgcgatggagcgttccttgagcacataggcatccacatctgccttgaccgctcgctcgaaatagcccggtcgcttgaaggtggtcatgatgacaaccttgacaggcaaggcttgaccccgcacccattccaagacatctaggcccgtcttttcaggcatttctatatctaataacaccacatctactggctctttttccaaaagagcaatggcctggctgccgttttctgcctgtaaaacagcctcaaccgcatcttgaaaacacaagagctgacagagggcgtcccgcagcattgcttggtcttctgcgactaagattctcattctaccacctcctcaaacggaattcggatggacaggcgggtgggatttgccagagaaagaaactccaaactgcctttcaccgtcaccaacctgtcttttatggtatgtaattcctgaccagtcaacttggcaaagcccacaccattgtcttcgtagtataaaaccaattcttgctggtctttttcaaaaaccaaccggcatctgctagcctgactgtgcttgagcaggttattgcccaactctctcagcaccatagccagcttgttctggacaggtaagctgagatgctctgctatttccccgcccaagacaagcaaatccactcctgccaggtccaacatctgctgtaaaatctggagttcctctgccacggtgtactgcttgagggactggacaatctggcgaacatcctgcatggagtctttggctaaggtctggagctcctgcacttccttcttggcctggtcaatctgatcatggtctaaaagtgtctggaccagctcagccttgacagacagcatggcaaagacatgccccagcgtatcgtgcaagtcctgaccgatacggttgcgttcattctcagccagcaggagattgatggacgcattctgctcctgtaggcgttgctgaagggcttcccgcttgatctcaatccagctgaaaatcagcaaggccaagccaaagaagtggataacaagtgcaaaagctctcatctcaaaaggaacagggccaaagagagcccagaggataatggccagtaacaagatcccataggacaccgtccgataggtcggccgagtttccttgtagtaccagcctagcatattggacaggttaaagatgaagagggaaaattgcagattgccccaaaaactcatgacggcgatatagccaatcaggtaaaaccaagccagcagggaatagagcttgtagtcggtataaaagagggagcaataaaccaaggcaaagagaatagtcgctaggacaactgctgttggattgggactatactgggcatagtaaaagggaaaatagagaaagaccatgcccacgaagaacatgagcggcacctttcttttttcaaaaatcacggcttacctcactgttgctcggattttctattcagaactagagcaattcctaagaaaattatcgcatagcctaggacaattagcaaggatttccagagaaaatctccctcttgggcataggtggtcaccagctggttgacatggtagctaggcataagtttacaaatccgctgcacccagtctggaaagagggaaacaggcatccaagagccacccatgatagccagaacaaagtagagcaagtttgccacaaccgacatggcctgttcagactggatttgcaccaagagcaagccgatagctagaaatacgatagaagttacaaggagtatgagtgcggacacgacccattcctgagctgacaaatctactcccttgaccaagccacccaccgcaaagacaacggcaatggaagatacaaagcagagcaagacccgtaccagtttggataggtagtagtgccagattggcaggggtgaatgctggataaaggtcaaccagctattctttctgtcctctgccaacatcatgggaaaggtgaaaagggcaaagcccgacatggaaaaacctgtcattgtcagcatgtaggactggataaaggccttttgcatggctgcatcatcaaaccggaccgttgatgagaaaatcaggaaaaagatgacgggcataccgatagacaggagaaatactcccaaacttctggataattttaccgcctctacttgaactaatgctttcatgattcttcctccctcgtcttgtcaaataggctattgagcagagttttattctgcacttccaggtctgaaatccgacaacctgcctcctgcaaactagcccaaacctgctcaatagctcgggtcttgaagctgaccgtatcttgtttgtagctgatcccattgatttcagccaagctctccaccaccgccgcaaaggcaatcggcaaagtcacttctttttcttgctcctcactccgcatagcaaatggcgtggtatctcttagtagccgcccctgatgcaagaccaaaatccgctccgccgtatgctccacttcctcaatatagtggctggtataaaaaatagtcacaccctgagccttaagttcatggacaatctcccaaaaacgctggcgggtcgaagtatccatgcccgccgtcggctcgtccaagaagagcaacttgggcttgccaattaggcagatgacgaaagccaagagccgcttctgaccacccgatagcttgccggccagttgatttttttgctcttgggaaaagcagagcaggctgtcgatttccacatctgtcagactatccttgtaaatagcttggaaaaagcggagtaattccttgaccttcaggtctgtcgggatagcattttcttgtggtaagactgctaccgtttctttattggaccgagcctgtggagccagaccgtccaacaaaacctggcctttcgtcgcctttctatcacccaacaaacaagacataagcgtcgtttttccagccccgtttggaccgattaaagccacacattctcctgacttgatttcaaaggaaatagtggacaaaatcgtccgtcctttgatgattttttctagtgcttgtacttctatcatttttctacctcctacttcttgaacatcttatagtcttttagtttacttttagtactaggcaacgagccgcaggcataactggaattaggcaaggcgagttaacgaagtaataaaagaaaaactaaatgacgatacatagacagtatatctcgaaaaaggagaccccactagaagcctttgtcatggactcatgtgacaaatgtcatattatactcaatgaaaatcaaaagtagcctaggaaacgaagtcgaagatagatctggagttcatcaaggcaagttgacaacggataattttgatattcgaagagtattaaataatgtagcaaaaaaagagtcctactgtggacccttcatctatttacaacttaggtgcttgaccaagttctgcctgcagcatccaaatatgtttttcaatactagccttagccacattgaaaatgtcgttggttacgctgtcaccttcttcatcactgacatcaaaccccttttggaaaagagcagccagatagcggaacacctctaccacacgcgccaattgctcttcaatcgttacattgtaatcaccaagaacttccttgagctgactattttcactaaactctttaagggtagaaaatggtgccccacctaaggtgattaaacgctcactcatctcatccaaataaccatcaatttcttccatatattcatccatctttggatgccaaatcataaagccacgaccacgcatataccagtgaacttgatggaggattgaatgggctactgataaatcggccaccgcttgattcaaaacagccttagaatcagccagtgatggacgcgggctgaaagacgcaatttctgctggagattgataatatttttgtttcatcatatatcaccctttcttttatttataataattataaataaaagaagaaaaaattgcaagaattatccctcctcctctgaattattggcagacaaattccttgctatattaacttatatacgttagactagtaagtaagaatagtatgtgattttctttttagaaaatcatcgcccccatatgtgtatatcgaggagggattttatgtcagaagaaaaatttgacgcaaaactagaacagctatctggatctgcaaaagaggtaattggtaagctgaccggcgacaaggaaatcgaagttgaaggacttgttgagaaaggaattggcaaagcaaaagagctagtcgaagatgcaaaagatgggcttgaaggtgccattaacggcatcaaaaatgctttcgacaaagaagagaaataaacaaagagttcaatataggtaggattggtcgtgcactgtttgataatgaacattacacttaatttggtcttttacctatagcccgaacaaaaatatgcaagagaggggaactcagacatttacctgtcgagtctaccttctcttttcttatgtcacgaaaggagtatctatgaaaaaaatcgtttttgtctgtcttggaaatatttgtcgtagccctatggctgaatttgtcatgaaagacatgacaagtcaatttcacattgaaagccgtgctacttcaaactgggaacatggtaatcctatctaccctggaacacagaaaattttccaaaagcacaagatttcctatgaccaagataaatcatcacagcaaatgagccagacagatttcgaagcatttgatattatcatcggtatggacagcaataatgtccgagatttacagaaaatagcaccagcacatgcccaaaataagatttttcaattcgcagaaaaatccgtaccagacccttggtatactggagattttgacgaaacctacgaaatggtaaagaaaggttgtcaagactggttggacaggttacagtcatttgatcaagaataagattttctatgtaatatttttgtaatatttgtaaaaaaatggtaaactatttctgactgaactgataatttcttactgtatcctagaaagaactgattagcatcggtcaaatcctatgaaagagtaaaacgatgaaagagttcaaattacctagtataaaatggcatgatataacaagtcatttcacccgtccaaaacttgaaatcctctcccttattattatcctcatctgtgccctctctgtatttacagggcgaattgccagcaagcaagccatgactttcaataatggcgccctgcagtacaacggttatgtggtcgcaaataaaatgaatggtcaaggaaaattgacctttgataatggagatgtctacgaaggacaatttacaaatggaattttccacggtcaaggaacctacacatctgcaagtgggtgggtttataccgggcaatttaaaaacggctatgccgatggaaaaggaaaattgaccaccgaaggacaagctacctacgaaggaacttttaaacaggggatttatcaatatgaaaattaaatggttatccgttatacgtgtgattggattagtctttgtcctactctatcatttctttatcaaatatttcccaggtggctttgtgggggttgacctcttctttaccctgtctggatatttgacaaccgcccttttgattgatgagtttgcaaaacataaaaaaatagatattgtcagctttttcagaagaaggttctatcggattctcccccctctggttttaacgattcttttggttcttccacttgctctgcttgtccgcaatgatttcattgccaatatcggcaatcagatagtcgctgcgctcggattcatgacaaacttctttgaaattctatcaggtggtagttacgagaatcaattttcacctcatctatttgtgcatacttggacactagccatagaagttcagtattaccttgtctgggctggtttagtttggtatcggactcgcatctcaaaaagtgtggggcaactacgtggatcaatttttctaacatctataagcctcttctcgctaagttttttagcaatgtctatctcaagtttctttgtagataatttctcaaccatttactactcgagcttcacacataccttcccattcttcctcggaagcattctcgcaaccatcgctggtatcggaaatacaacaactgccttccagcaacaagtgaatacattgagtatcaaacaagctataggtctgtttcttggaggactaggagtagaacttcttcttctctttactcttcaattcagttccatctggacctatctaattggttttcttctatccagtttagctacagcaactatgatttttgctgctcgggtacttcacgagaaaaccgaagatgtcaaagaacctgcaattatcctcttctttgcaagtatttcttatggtatctacctcttccattggcccttgctcattatctttacacaactgacaaatgccactatcgctgcgggattatcctttgttttttctactatcctatcaactatttccttctatattctagaaccatatattgctggtaaagtaggaagcttgtttggattagcaatagacttaaaaccctataaaaaatggcttcttagcagctttgcttgcttgaccatagttggcttaggtatctgtctatttggaccaaaattaggaagttttgaacaagagagcatggttagcaatctttatcaagctcagacccaactaaatacaacacgatctgctgctgaaaacgctaaagctactagttttgaaattcaaaaaggagttatcatctttggcgattctgttactgttcgcgctagttctgccatacagaccgcgctaccagatgcacagatcgatggaactgtcagtcgaaatctctctgaaattgctaaattgataaatctttataagcaaaataatagcttgaaagagactgtagttgtagcgctaggtacaaatactacggataattatcaggaactactagaccaactagtcaaagattttcctaaaggacgtcgccttatttttgtcactccttacgatggaaacttcactccgagcgaatccatttcttatcaaactggtcaatacgagaaagaattggctgaaaaatatgattatatttccattgcagactggtatcaagttgcaaaggataatccaccaatttggtacaataccgaccttgttcatttcaatcttgaaagcaatggaggcgaagtcttcgcccaaacgataaaaaatgctgttgaagccgttgctgatggtccaatcaaaaactagatttatacatcatcatcctctgagaatttctcggaggatttttgcacgattttccgataagtccagtgcgaactctaagaaatggcgctgtgcctgagctcagtctcaataaatcttgtgaaataagccacttctacaaaggacggaaaagcgaagtaacgataatagaaagatgacaagttaaaaaaactcctaccttttacagtaggagttggtgtcaaattgactatttttgcttactttggaaacgccattcaaagcgtttctgatcgtaaaatggatacatcatttgtaaaagagtgacggcaagtagccaaccaccgataatatctgtcgggtagtgaaccccaatatagatacgggatacagctaccaggacagcaagtagaatcaacatggcttgtagcacaagtctagctatgcctttcttcatcctctggtgaacaataataacaactgctcctccaatcatcatagttgatgcagtatgccagctaggaaatgaataaccgatggtatcaatcaaccattcaatacttggacgcggacgttggtagacatatttcagggctgtggatgccacacccatcgccgcaaaactagcaagtaggaaataagcttctatcttccattttttatagtagtaaaagatagcagctagaatcatggtaatagctaaaataataaccgtatttcctaaaacagtaatagaggtccaaaattgactggctccacttggtaaatttccacgaatggcagactggacagtcgaatcaaaacctgctagggtactaggataaaattttactacatagcccaatgtcacaaaggccagagcaaaaaaagatgcgtttcgtaaatggatttgtttattcttcatacagtatagtttaccttataaaggttaaactttctttaaaataggttgggctgctttgtaacagatataaaatattgccgaaagcacaatcccttgtaaaagattaaaaggaagtaccatcataaaaagatagttagtcagacccaagatttctttaatatcaaaatttgtaaaagcagcataaacaggcaccgcataaacgtaatttaatgccagcatcactgctgtcgaaccaattgtcgcaacagcggctgcttttaaataattttttaacgtttgttcatttttccagaaataagctactgctaaaatgaaaactgacatagctgcaatattcatcggtaagccaataattgtcgatggtccctgattatttaaaatcagtttgagaaaagttcgtaccaaaaggatagcaaaactagacttcatatctagaataagcagaccaaataaaatcggtacgagagaaaaatccacttccaggaaactggctgttggaatcagtggaaatttcaaatacatgagcagaaaggatactgctgagagaatggcgataatcgtcattttgcgtgtgtttgtcataaggttcctccaattttgaaaattgaagaagcgtggaagagcaggcaaaaggcctccacttcgtcttctcccatccagactttactgtcggttgtggaattgcaccacatcagctttcgctcgcagactaccaacggtctattttgttctaaaactgcgttagctcatctcgacatacattcagtatggtcttcgattcgctgcctagtcgtaaaacaaattaccacgttttacactgccggtcgggaatttcaccctgccctgaagactatttcatcataccaaaaaagccttgcatttgcaagagcttggtaagttttcactattttaacttgtccccatcataggtgtgaaccaaatctagaccagcgaactgttgctgccgaagagcctcatatacaatcatacacgctgtattagagacattaagactacgcacatgttcatcattcattggaatacggatagccttctctggatgttcacgcataaaatcttctggcaagcccttatcttcacgaccaaataagaaataatgaatgttcccatcattatagtcttcatccgaataggttttatcagcaaatttagatactaagtgaacacgtccttgtttgctggcataatccatgaattctgctaaattgtcatagaagcgaacatctaacttatcccaataatctagtcctgcacgtttcatcttacggtcatcaattggaaatcccataggcttaatgatatggagaggactattggttgcagcacaagttcgagcaatattgcctgtattctgtggaatctgtggttcaaataagacaatgtggtttttggctgtttcttctatatactctaatgtttcaatattcataagaacctctctggtgacatttcactaaacacgaatacccttcgaaaatcaaatccaaaccattgtcagcttcattttgccgtataccagtacggtctgttgcttgttgtctagtttctttttttgattttcattgagtaaaaagactcgactgtctcctatggcaagaaagacaaaaaaatagccacactgcccggagtcaagctcagcaaacagcatggtgaatgatgattcattcacttaactcacaacaggtttgagttaaatcaatgaaatcgtgatactattgtagcttaaagaaggctgaaaatcaagagttttgccccatttttttcaaattttcatagaaaatcatggaggctgggcagaaagaccaaccttgcttctcagagttcgtgtcaacatctgagcgcagtgattgattggcttttacagtccagtggactgttaatattgaggcgaacttgcttcgccctatctccagccttaaaaggctcccaaatcttttgagagagtactaaaggcaacctaaaaacctatatttatacagaacaaaaagtaggttgccctacttctgcttatttcttttcaaactaaacctgtccggcacaggatcttctccaccttccaccaagggatgacagcgaccaattcgagccaaccccatcaaaaagcctttgagtccatgtttttgtaaggcctcgatcatataagccgaacaagttggacggtagcgacaagagggcggaaaaaggggagaaataaatttctgatagaatcggaccaagccgatcaaaagtctagtcattattttttaactggcttagtaacggccagggtatgtagtttactgatgtctttcttattgagcttgcggtattctcctggacgtaggccggtcaagtcaagattaccaaagcgagtacgagacagcttgtctacctgcaagccgacagcctcaaacatcttcttaacctggtggtttcgaccttcatggattgttaattctacaactgagcggttcttaacagggtccacctttataatctcatacaccgcaggcttagtctttttgccatcaatgacaacaccacgggtcaagggacgcaaaacttccttgttggcaacccctttgacacgcgccaagtaaaccttatcaatctcattacgtgggtgaatcatttcgtctgtaaaatcaccgtcattggtcaaaatcaagaccccagatgtatcccagtccagacgtccaactggataaatccgttccttaactgttggcaacaagtccacaactgtctttcttcccttgtcgtctgacacactagaaataacacctcgtggtttattgaggagatagtagaccttctcttcgttataaattggttgtccctcaacctctaccttatcacccgatttgataactgtccctagctcacgaacaacctgaccatttacagtaactagtccttgtttgattagttcttctgccttacgacgactggcaactccagcatgggcaatgtatttattaattctcattttctaactcatttctttctacgaatagctctgtttcctcttgaatcaaatctatttcagacacatcaggcaattcttctagactattaattcccatgtaatccaggaaataatccgttgtcacatagagatttggtctaccaagaacctctttcttaccgttctcacgaatgaggtcaaaggcctgtaatttactgatggcaccactggaattgactccgcgaatatcatcaacttcaatccgagtaatgggttgcttataggctacgattgataaggtttccaaaagagcccgtgacatagtctgattgattggtgttttggcatagattcgcaaaaggtttgcatattcttttttagtaaccaacttgtagcgattggaagactccaagatggctaagcctgaggctttgtctgccatatatttctcactaagtttctctaactgctggctgacagctgtcggctgcatttccaacatctctgccaaatttcgtaacgtcaagccatcctcacctgccacaaagagcaggacttcgatttcagctaagcgattcatcttcactccttactagataaatatctccaaaagtctctgtctgctccaggacgatttcatgaaccttgaccaattccaaagtcgcaaggaagatcgtaatcatttcattgacatcttgactttcttgaaaaagctgacggagttcaaggcgtggaccagtctcgaaacgactgcgaacaaagtccatcatgtcttcgattttatattcatcacgggcaatggtcgcatgagactgacggaggcttgcctgtttttcagccattactttagaaaaagctaggaaaatgtcaatgacggtcttatccttggctaactgtacatcatcataaatcaaatctaatttgggttttgaaaaatagttggcccgttcatcatgttgctcccctaatttctcactgagaagtttgaacttgcggtattcttccaactggtccaagaggtccatttcaggatcatcttcgggatcaatttgctcaacaaccttcggcaataaccgacgacttttgatgaccatcaattgactagccatgagcatatattctcccgctacctctaaacgcatggcttgcaaggtagcaatgtaggccaaatattgctcaataacctctgtaatcggaacctcgtaaatatctacttgatacttggacaccaggtgtagcaggagatcaagtggcccttcaaaatcttttaattttatatccattatctaaatttttccaaactcatgcttgttttcagtcccaactgcttggcgatttggtccaaggattttccttcgtctatctgttttagaatatactgctctcgcaatttttgggctgtccaatcaggcttgccgatggactggacaaattctgtcagacgattaaaaaaccattgacgagaataggtctgtcccttcttatcgaagacatagcgtccagacagatgagactccatatagggtatcaattccttgggcagagtgagcacccgcttggctcctcccttctcaactgtcaggacttgaaaatccagattgacctgctgactagtcagctctgctatttcacttggcgtcaaacctaaatatgctatcaaaagtgcgatgagctgaccttctagccaaggactttcttgaaagaggagagttaaatcctcacgctccagtttctttttgacgctggctggacctgacgtcgtttgcaatttataaaaacgatccaggagattattttcataaagaaagtagagaaattgattgaccgctgacatttttcttttctgagcagcaggtttcaagtctagaagagactgctgatagaccaaaagagactgttggctaatctccccctttgttactgtcacaaactgctgcaggtcataggtataggacttttggctgttgacactgacctttttgctctggataaaagattcaatcgcctgcttcatttcttgccttcttttgatgctagggggaaattatgcaagagagcattgattgcctttaagatggattttcgtgtaatgattcccataaattctctattttccccaaggacgggtaagaaagattgatctactagcttacgcatcacctctgtcaaatcataatccagaccaaccgtctcttcatctgtctttacaatcacagaaatatctctgtttaactcatcatccgatagttcattttcagcttgatatttaatgatttccgtcaagccgatggttccaaaaaagcggccatcttctgttaccacaggtacgcgtgaataggtcatgtgactgagtaacagttttgcatggtcaatattatgcgtatcaataattactgccaatttatccgctggtgtcaagaaagtttcttcctggtccaataaaaaggcttcaaattctcttgcaatcatcttgaaatatcctttgtcaatgctgggtaaagttggtgctgtcgattgtagtaatccacatggaagtgatcatcatagatggtcacaagagcatagagacattctctgaccaaaccacgaggttgactaacggagccaggattgaggaagagggtcttgccacgcacttcggcatcaggcacatgcagatgcccatacaaacaaatatccgcatcaacttcctgggcccaataatccaaccgctgccagccgtaattaatgccataaagatgaccatgagtctgagcgatagtcacaccatccaattgagtaatgagctggtcagggtaaccaccaaaatagtcgcagttcccattgaccacttgaatgccgtcccacaaactatcttgactatccagctccgaatcaccattgtgaaagatggcatcgaccttgctaagataatgatgtttaatatcctctacaatctgtctatccccatgagagtcgctcatgactaggattgttttgcttgctcctgccatactggaaatgcctccactaatttttctagtgcttgtgcacggtgggaaatcttatttttttcttctagggttaattctgccgaggtcttacctgtttcgcctacgaggaaaagtggatcatatccaaatccattttccccacggaggtccataccgataaagccttcccagtccgcttcgacaaccaaactatcacgatttggagcagccatgaccagagtacaatggaattgtgccgaacgatctttcagttcaaataccatggccaattcgtgcaagagcttggcattattgagctcatctgtggcatctggacctgaaaaacgggcagaccaaactcctggcaggccacctaaagcatcaaccttcaaaccagaatcatctgccaagaccatcttgcctgtcagctctgctatggtttcagccttgagccgtgcattttcctcaaaagtcatacctgtttctgctacatctggcaggtcaggatagttgttgaggttctcgacctggtagccaaaacgctcaaaaaacttacggaattccttagtcttaccttcattttttgtggcaatcaagatggtatctcccacgcttgccaatcccttgtcttgaccgaagaaatctgccgtgctaacccctgcttgtggcagatgaaccaagagaagtttgtcattctcagttaccagaatagctccttggtgttggagggccttgaactgacgattgtttaactcattcaaagtatcacaggcaaattgaaagagggcaaattcagactgaagtttgatcacttcaatgttgacacactggttaaagttctcatcttcataattaccagcaattagtttgtcaaacaattgaccaatctggtaaatttcctgctctctgccattttcaccaaatgaaccaaatagattggcaaagctggcttttccaataaaccaattgtgttcatctctgtattcgtatatcttgtctgtcatagttctacatgctccacatgaatatcaatgcccatccagctttcagctatttctttaaaagctgccggactagctgttgtgtaaaatctgtgctgaatatccttttcggtacggctgcggttgatttgaaaataatttaataaaacagaaatatctcgcgcacattctgccccactgtcaatcaacttgacatccttgcccatggcattctggatgatagggcgaagcagaggataatgggtacatcccaagaccaaggtatctacttgcccaacaagtggtcgaagtgtctcataaacaacctttttggccaaactggattggtggctattggactcaaccagtggtgcaaatttgggacaggctaggctgtctacctgcgtttctggagaaagggcctgaattttttcacgatagatatcggattgaatggtcatagccgttcctaagacaccaaccttaccagtttgcgttgccttaatagctgccgaagcacctggtaaaataacacccaaaacaggaatatccaacttttccttgacttcttcccagactaccgctgttgccgtattgcaggcaaagacaatcatttttacattttttgtcaaaaggaaattgaccaactgccaagtatattctctgatttgttctgctggacggggtccataaggtgcccgtgccgaatctccgatataaacgatttcttcatggggtagttggcgcattaactcacgcgcaaccgttaatcccccaacacctgaatctaaaaaacctattggtcgattatccataatactgagaatagccagaaaatctgactagcctttcttttctactcaaaaaatgggatctgggaatgaatatcccagtcccagtttgattattttttcttgcttgccactttttgttggctcttgatttggcgaagtacttgttgtacttttgcctcgcttggtttttgccccatttggctcatcatcaaacgcaaagcattctcatccaaaattggtttatcagcaatgtagttttctacctgtctgcgtgacaagtaaatacccaaggccacaccacctgcaaatgccaatacaataagtaaaatagctaaacctaagttcatctgtcaatctcctgactcttctaaaaagtatacttctgattgtttttaacaatctttcaataaccctattataccaaattccctagtcttttccaagacttacctgtcaaaatcaaaaccgtaaatagttgcgaaatagtcttctggtgtttcagcacgacgaatcatccgcgctgtgccatcttcctgcaaaaggatttcagaagaacgcagacgaccgttgtagttgtagcccatggagaagccgtgggccccactgtcatgaatgaccaaggtgtctcctacttctacccgtggtaattcacgattgaccgcaaacttgtcgttgttttcacaaagggaaccagccacatccaccacttcgattggcgcatctgggcgcgtgatattggtgatatggtggtaggcgccatagaaggcaggacgcatgaggttggctgccgatgcatcgacaccaatataagtccgataggtttccttacgatggagcacctttgtaatcaagtgaccgtgtggcgccaacataaagcgacccaattctgtaaagattttaacatgtcccataccagctggtgtgagaatttcctcgtaaaccttacgaactccctcaccaatgacagcaatgtcgtttggttcttgctcaggacggtagttgactccaatcccacctgataggttgatgaagtccaaggtcacacctgtttcctcacgaatttccaaggccaattcaaagagttgacgagctaagacagggtagtagtcatttgttactgtattcgaagctagaaaggcatgaataccaaactgcttcacacctagttcttttaattccttgtagcccttcatgagctggtccttggtcatgccaaacttagactcttctgggtggtccataatatccgttcccagcgagaagaccccacctggattgtaacggaggcagaccgtttctgggataccagcaacatttttcaaaaactcaatatgctcataggcatcaaggttaatggtcgccccaacttttctggcataaacaaactcttgcgcttgggtgtcattagatgtgaacatgatgtctttaaagcccaatttttcactcatcagcacttctacatccgttgcacagtccactccacaaccttcttcttgcaagatttttaaaattgctggtgtcggtgtcgctttgaccgcaaaatattctttaaagcctttgttccatgaaaaagctgcattaagggcacgggccttctcacgaatgcctttttcatcatacaaatgaaaaggagtcggaaattgctccgtaatgttttctaaaacttctttactaacaaatggtgtcttggtcatgtcactacctcatcaaatatttttcctattatatcacaaatatgtgaggaactgtagctttcaactccaccaaatacttgcaaaataaattatgagcgctataatgtgattatcattaaaaaaggagtaatatatgtcaacattagattttgattttacagaacgcttatatgccaactatctagctaatccaagcctacaggcaaccgaaaatgccgttagccacaacggacttttgaaatccttagaaacacgccaaagcgccatcgacaatgactatgtcttttcaatcgacttgaccaaggacgctgtttcaaaccaaaaggcttctggacgttgctggatgtttgctgcattaaacaccttccgccataaactcatctctgacttcaaactggaaaattttgagctatcacaggcccataccttcttttgggataaatatgaaaagtccaactggttcctcgaacaaatcattgctacagctgaccaagaaattggtagccgtaaggtaaaattcttattggatacccctcaacaagatggcggtcaatgggatatggttgtggccttatttgaaaaatatggtgtggtaccaaaatccgtctatccagaatctatctcatccagtgccagccgtgagctcaatcagtaccttaacaaattgctccgtcaagatgcacaaatcttgcgagacctccttgcaaaaggagcttctccggaagaggttcaaacacaaaaagaaaacttgcttcaagaaatctttaacttcctagccgtcaaccttggcctccctccacgtagctttgattttgcatatagagataaagacaatgtctatcaccgcgatacaaatgtgacacctcaggcattctacgagaaatacgttggtttgaaactatctgactatgtctccattatcaatgctcctacaactgacaaaccctacaataaatcttatacagtcgaattattggggaacgtcgttggtgcccctgctgtccgctacctcaatgtagaaatgaaccgttttaaagaactagctattgcccaactcaaagctggtgagtccgtttggtttggttccgatgtcggtcaaagcagcaatcgccaaacaggtatcatggcaaccaacacctacgacttctcttcaggtctgggtatccatttccatcaagacaaggctggaagattagactactccgaaagcttgatgacccacgccatggtcttaactggtgttgatttagatgacaatgagcaacctctcaaatggaaagtagaaaactcttggggtgacaaggttggtgacaagggatacttcgtcgcatcagatagctggatggacgagtacacttatcagattgttgtccgaaaagaattcctcacacaagaagaactagcagcttatcaagctcaaccacaagtccttgccccatgggatccaatgggagctctagcataacaaacgacatataaaaaagaggtaaatcctcttttttatatgtcataattagtctctactcaaaccaccaaagatacggagtaggttgaggaagaggttgatgaagtcaagatagagctgaagcgccatggatacgacccacccttggccaacattaccaccagtttgttcgaaaacattgcggatacgttggttgtcataagcaatcaaacctgagaataccaaaacagaaatgatagacatcataaagcttagaccagagctacgaaggaagatattaataacacttgcaataataattccccatagagctgcacgcaatgcctgagccataccagaaagatccttcttcgttgtcatcccaattacagccatgatagcaaacataagagccgctgacacaaaggcaagcacaactgtttcactagtatagaacatcaaaatcatgctaatggtgataccatttgttactgagtaggcaagaaacattggtagagccattgggctatttttagctgccattgctgaagcagaaacaaccaaggcaatctgaccaatcataatcagcatcatgatgatggaacctgcactcagcagactaagcaataaagattgaaagacggtcacagccaagaaagaaactagagctgacagaccaattcccatggcaaccacaccataaattttaccgaagaaacggttgagggcggtattatccacctgattaataataaatgaatcgttattcatactattctcctttaaatcatcttattgaaaccgaaagaccttacgatttttccacttgtgttgtaagggcagactccactctctcacagcccaatacttatccacgcatgtcacaatccaggattccttgtagcaaggaggagcgattgtcgcaccaaacatatgcttcacaatgatgtcttcttctagtttattgagttgaatgagtttctgagcattgcgtttagcaattcgtggatgaacccaagcatggctcttgttgaatttggtatctctccagtcatagaagaataaatcatgcaatagaccaccacgagctgttgacttggcatcccaaccaaattttttcgcaatcttataacttgtataagagacattgatggaatgttccaagcgcgtggagtgataatgatgaggaattttccccaatttttgcaccttgggtgtggcaatcaagtgccccacgtaatgcatgtattctttatcttgtttatatgcaaccattcgttaacctcgttggaatattataccacactatagtacaattggcttaaataaagctaaacaatagaatacccgccgcaattgctacattgaggctttccgcctgccctggcatggtgatatgaacaagttgatccgcctcatcagccactaaatcagaaattccctgaccttcgtttcccatgaccaaggcaaaactagaatgtggcgtaatttccttatagtcaaccgactgactagagagggtcgttgccaatatttgtatctgattgcttttaagagctgtaagaatggaggaaattggcatccgataaactggcaaatggaagtgactcccctgcatggaacgaagcactttcatattataaatatcagccgacttatccgatagaaatactccatcaaaaccagctgcatcagctgtacgaatcattgtcccaacatttccagggtcctgcacatcttcaagaaccaaaaattttccatccaaagtctccggtaaacgttggctcggcaaagcaagttgagctactaccccctgaggcgtcttagaatcagctaattcttgcataatttcaggactgacaactgtcacattggctaaacctgcaaccttttcaaaatactcttccaccacaaaaatatgctcaatattggctccagcctccatcgcttcctccagcaaatgccagccttcaatcaaataagaagaagtacggtattttttctgttgtaatttcttaacctgcttgaccaaatgattggcctttgagcgaatgatctccatgaatgccccttttcttttactgctcagcaacttcaattttccaacggctaaatcaattatcttgatttttgaacagtcttacccaaccatgatataataaagtaaatgtcttgtcaaaaggagaaacttatgcgaaaggtaaaaatgattgcatctggtcgtgtgcaaggagtcggctttcgttggtctgttcaatttttagctgtggaaataggcgacatctacggcagagtttggaataatgatgatgggactgtcaccattttagctcagtcagataatgctgagaagctcagccattttatccatgaaattcggaaagggccttctcgtatggccaaagtcatctatctagatgtcaccctagccaattttgaggactataaggattttcaggttagctatagataaaacttgtatatttccgtcaaaaaaagtaaaatagagagtatactgaaaaaaacaaaggaacgaaaaaaattgaaaaataaacgtctactcatcttgtcaggcatggccttatcaactcttcttttcttatctggttgtgttcaaactgataaaagcggaaatcctacaggtcccatttgggattggttgggacaaccaatgtccaacttgattcgcttttttgcagaagatcaagctctaggatttggtcttgctattatcatcgtcaccttattggttcgattcatcatcctcccattgggaatttaccaatcttggaaagctgctatccaatctgagaagatgaattatctcaaaccgattttaggcccaatccaggagcgcatgaaaaatgcaagctctcaagaagagcaacttgctgcgcaacaagagtattttgcaactcaaaaacaatacggtgtgagcatgctcggcggaatcggttgtttgccgatgctgattcaaatgccattcttctctgcaatctactttgcggctcgccacacaccaggaatttcagaagctactttccttggtattaatttaggttcaactagcctgattttgacagtcgttgctggtattttatactatgcccaatcgctcttaatgcaagtcggcatggatgaagaacagaaaaaacaaatgaaaaccatggctctgatgaatccaattatgatcatgatgttctcatttgggtctcctgctggagtgactctctactgggttgtcggtggtctcttcggtattcttcaacaagctattacaaacttcattttgaaacctcgtattcgtaaacaagtggaagaggaattcaaaaatatcacagtgtcagcaactcctcgtaaaacgaaggacgttactccaactgcttcagcagttattgaagaaaagacatctaacaagaagagaaaccgtaacgccggtaaacaacgttctagataaaaaatcgcaaccatctatttcagatggttgttttcttatatagacactatgtaaagatccccagttgagaattcgtggatttacctgtacactagaataaaaaaataatcaacttctaacaggaattaccacactcaattagaggtctttacatattgtctatacaaaaagagagaatctttcgactctctccacaccttatttcgttttttcaaccttcaagatttttacatcatagctaccagcaggtgtttcaattgttgcaacatctcctgtttttttaccaatcaaagcatggccaattgggctttcgtttgaaatcttgtttgcaaagacatctgcacctgcagcaccaacgatatgatagacttcttcctcggtctcaccaacttcttgaacagtcacagtcttaccaattgctacttcatccgcagcaactgcatcactgtttacgatttcagcatagcgaatttttgtttcgattgttgagatttgaccttcaacaaaagcctgttcatctttagctgcttcgtactcagagttttctgaaaggtctccgtaagaacgagcaattttaatacgttcaacaatttctggtcgacgaactagctttagttcctctagttctttttctaatttttccttttcttccaaggtcattggatatgttttttctgccatttgtctttccttttcttttatttttcatgaaaacaaaattatgtggaaaaccacataattttgttttaagaatttactcattattaagatgtgcatttacatacttagcaacgttttggttatgttcatcaatattatttgtaaagtaaacatttccagttgtaacatctgctacaaagtaaagatagtctgttgtgttggcattaatcactgcctcgatagccgaaaggcttggactatccactggtccaggcatcaatcctggggtccaataaatgttgtatggtgactcaattgatgtatcaatcgctgcatcttctgctagagttgtttcttgaccaagtttaccctgagcatacaagattgcaatattagattgtagaggcattgctgcattcaagcggttaaagaagacacttgcaatgtttcgacgatcttcatcagtagaaccttctttttcaaccaaagatgccaaggtaagaacttcatttacagtcaaattcttagcagtaatcgtttcataatatggttgtaaacgattatccatcgcggcaatcatttgctcaacgagctcttcgatagttgtttcatcgctgtattcataaaccgctgggaagaggtaaccttccaactgataaataactccactatcagcagctggtaagctggcaaacaattttggataagtagcaaccattcgattaataaaatcttggttggtcacagtagccataaactgttctgcagtaaatggtgttttatcgttcttatcttttgtattagtattgtctgtaatagcctgagcaatttgtgttaatgtatacccttcaacaatcaaaaccttccctgcagcttctttttgagctgtcggagttccgctttcttgaagtgctttggcgatgtcatccacagacatattttgttttaaattataaaaaccactttggaaattattataactcttaattttagagtagtaattaaaaatagtagcattcttaatcaacttgttgtcaactaaaattttaccaatttctaaagttgaagatccttctggaatctctacctgaatagtttctgtagcttttgcattaactggttccagactagattttacccacatatagccagtaacacctgtcactaggactgccactacaacaatcgacatgataacagagacaatgtgtttagcggcattatcttgttttttacgacgttgcttgcttgttctgtgggttgttcttcttctgggttgtgtttcctgcatctgcttgtctacttctggaacaatagccgttgtctttggagcaataatagtttcctctagtgcgatgatttctgtatcacccgttacagctgatacatcttccgttggaaattccaaaaatgtatcttccaaagaagacttctctgaaaggacagactctactggctcagaaactgacgagcttgatggtacttcatcaaatcctgccgtattagcagccacaagattccttaatttctccaagtttcgttcaacagtatcttgtggaactggacttgaaacaacttctttttcaatcacaaaagtctctggagtagccaaagtttctgatgttggctcttcaatactttccgtcatcacttctgattcttgctgttcttctgacaagtatgaatcagggaaagcaataccttctacttttacaatttcagtctctctatggggggctttttcttcggcaagactaggctggagctcattgataacttcattacgcttatcaacaagaacatccgctgactgttccgccaaacgtttcaccttcaattcttccaaatctcgtaaaatttgatcgcggaagcctgaagactgcgtgtttttttcattcgtatcctttgtcacgctgttactcctttcacacagttactatacattatatcttaaaggcttatgaattgcaagaacttccctttctacaaggctttccagtacatatcactccacctttgtcctccaaattgcgacaaggaggggccaaaatcttcaaactggttcatttcatagtagctaatcaaatacctcttacaggtcagggaaactccttcaaatcctcccgctaaagccacttcttttatggctgccaacaaaagagttcccactccctgtcccttataggcatccgctacggatagactggcaatagctaggtgaccgcctgtcggcatgtcactctctgtcaagtaaaaaatatcgtctgtaacagtctgcgaaacagagggacaggataataaatatcctgctatttcctcatcgtgttccattattaaacaggttttactcaaagtattcagataagtagcaagaacagactcagctatccgttcctctttagaaaaattggcattttcaatcaaaacaacctgttctaaatccgaaggagtagcaaaacgaatttccataattttctcccttatatagcggaaaaacaggggccataggcctccgtctttctttttattggacgttatttgtaagatttgacaagagtctttcgaaggaatattcataggactgaatatcaccagctcccataaatacatatacggcattgtcatggtctaaaagtggtgaagtgttttcaactgtaacaagtccaccttttttgttgattttagccgccaaatcttctaccttaacctgaccattgtctgtttcacgcgctgatccataaatttgagcaaggtaaactgcatctgctccattcaaagcatctgcaaactcatcgagaagcgcaatggtacgagtgaatgtatgtggttggaagatggctaccaactccttgctaggatacttctgacgtgccgcatcaatggttgcaatgatttccgttggatggtgagcaaagtcatcaatgataacagtatcattgacaattttctccgtaaagcgacgtttgacacctccaaatgtcttcaagtgttctgcaaccagttgcaaatcaaatccagcaatatagagattggcaataacagctgttgcattcatcacattatgcttaccaaaggttggaatttggaattctcccaactcttcttcaccatggcgaactttgaattgtgaaccacttgtagaaggcttcaagtcataggcaacaaaatcattattgtcttccaagccataatagtagattggagcatttgccgtgatacgacgaagttgctcatcttcaccaaaaacgaagagagcattttttacttgcttcgcataatcattgaaagcattgaaaacatcctctagactagtgaaataatctggatggtcaaaatcaatattggtaatgatgctgtattcaggatggtatggggcaaagtgacgttcgtattcatcggattcgaacacaaaatactgagcatttgccgaaccgcgaccagtaccatcaccaatcaagaaggaagtatctgtgatattgcgcataacatgtgccaataatcccgttgtagaggtcttaccatgggcaccagcaacaccgaggctcgtaaaacctttcataaattcacctaaaaattcatggtaacgtttgtaggtatagccctgggcatcagcataagcgatttccacattgttatctggacgaaaagcattaccagcaatcaattcaacatctgctgtaatatttttctcatcaaacggtaaaatctgaatcccagcttgttcaagcccgcgttgtgtaaagtagtatttctctacatcactaccttgaaccttatgccccatttgatgcaacataagagcaagtgcgctcatacccgatcccttaattccgataaaatgataggtttttgtcatgttattcctcttctatatgtgtcaaattcaattcttgtgccacttggcgatctcgttgttgtctgcgctcaggataattgtaaacctgactctttcttaaaaagtcatacgaatttttctttataacctgctcctgttctctatcttctttcttcaaagaatagacagctggcatatcagcgagaatatagtctgtctgacgtaggttgtccgccaaacgtgtcaaccgacctgccttagattcagctgttgaaacgacaggaggtttcaccacaactttagctggtgctggtttttcatctcttaagtaggttgctgatcgttttttcttcaagtcttctctagcctgttcacgagccaactgcccctgtgttttcactggagaaggcttcgttttagtcagttgctgaaggcgttccttgcgagaataatggcttggcttagcttcaaacagaggaggcaggagctcatcttccgtttgtgctactggttttgccgacgcaactcgctgtgaatcggtagaccagctaaattccttttcttgataaggtcccctgatattgctaatcaggtcgctctcatcatataaactcataattggattttctccaactagtacctcatcatctgcgactagtggaaatcttttttcatgtctaatcataagtcatcctttcgaacccttattataccatacttaggccttatttcctaattctacgctgagtcaactgattccatatcactcaatccctaaaatctcacgaatatcctcaaccgtcaaattcgctcggctttcattgccatcaagaactgttttaacaaggttctttttattttcttgtaattcttgaatcttctcttcgattgtccctctagtaatcaggcgatagcattcaaccttttcagtctgccccatgcgatgagctcgactgatagcctgagcttccacggcaggattccaccaaaggtcgactaggatgactgtgtctgcccctgtcaaattcaagccaacgccacctgctttcaaggaaatgagaaaggcatctcgacttcctgcattgaaggcctgtgtcatttcttggcgttggttagcaggggttgaaccagtcagagtataggaagtcatcccaatttctatcagctgttcttctattttttccagcatatttctgaattgggaaaatatcaagaccctgtgttcaccttcttttagttgcaagagtaattctttcaaactattaagtttgccactctcaccactaaactcttccatgaaaaggctgggagtatcgcagatttgacgtaagcgagtaattcctgataggatttctatcttgctacgattgatttgagcatcatctgcgccagctatttgagtccgcatttgttgaagctgggctaggtagatagctttttgttcatctgtcagttcattaagtacattgacctctatcaaatcaggcaattcctgaagaacgtcttccttatgacgtctgagaacgaagggttgaatggtccgcgcaatgtccttggctgctaatttaccgaagtcttgtttgcctggcaataaacctggtaagacaatttggaaaatggaccatagttccgtcaaatggttttcaatcggcgtacctgagagggcaaagcaattcccaacctcaaactcacgcagaagctgtgcaatcttagattgggcattcttcatgacctgcgcctcatctaaaatgaggtagtcaaagcgttcctgtctatagagtgcaacatcctgtctgaaggatggataggaggtaactaagacttggtgatcattggcaatgatctcttcacgctgttccttgtttccatggacaacagccacatctaaacttggagcaaaccgcttacactcatctaaccagttataaatcaagctagacggtgccaatattaaaactttggaatcttttgtcatccgactggacagaaaggcgatagtttgcaaggtctttccaagccccatgtcgtcagctaaaattccgccaaaaccatacgtatccagcatagtcaaccacttaagccctgtctgctgataatccctaagcgacgttgttacttccacagcaggaagcgggaacaaatctggctgagctagatagcttgccatttcctcaaattccttggagaaactgacttggttgaattgtgacaaggattgagccaattggtaaccggcaagagcatggacttgtacctgcccctccttaccatgacgggcccgcaaatagattagggtttgactgattttcttggtttcctcatcaaaaacaaataccttaccgctcgggctagtatagtgatcctcttgattcaacaaggctgtaatcgcctgatcgatttcagattgttcaatacctgataagtcaaacgaaatatccaaaagtgagccgttacgcacaatttctaattgaggtttggcttcaatatataaagcctgtagcctttctgctagatgaacctgccccattttttgtaatataggcaattgttgttggaaaaatggatagagctcctgctgactaagagccgctctctgggcatgatatgtccccctaaagccagctaaacgaatagcctgatagaccctctccaaatgttggaaatggctggcaaaaggcaggagagccaaatcctcttcactccttaccttacgtccatcaaaatccaaaaccaattggagtgataaactgtcatttgcctccatctgaatatgaaattctggcttgaaatcatgaatgatgaagcgtttaggtgccttaacagtcccaattgtctgcaaatccagcaagcttaaagccagacgattttggtcagggaaatctacctgcacttttctcaaacctgattcggttggaacaagttcggaaatttggtaaatcagatgttcttgatggcgattgacactataaaccgtgccatttactaagagatagcgcccatgaaaaagtggtcggactgttttttcgtgaataaccatttcaatcatctgcgtgtgaacggtcacctcaaaatgatagagcccttcctcacctgtcaacggaagaaccatcaaggaggaataggactgctgttgataggaaaagttaaaatgttctagctgatttaacagctccaacccctcctcaaaataggcttgtggcagacgaaaatgtcgtccaaaatgagtaagaatatccgaatctataccaactttctctggtaccaaggcccagagaaaatccaggagagcctgacttggttcatcaaaattttcataagtaacttgctcataataatttttacctatctgatagtgaccgttggctttcacaatgcgcaaaaaagctccgatgtcccgcacaatgtacgaacgtgtatctggcaagcgggtaattttcaaggtccaatctatctgacgatcatagggcaataagctcccttcaactgataactgatacttaatccccagttcaggttctggccgcaaaatttcatctaaaaagagaccaccaaaataagtccgacggacggtttccttatgttgttcaccatcttctttcaaagactgcttcatatccttgcctgaggcatcattttttaaaaaatactccgtggcagctagatgttgacagtaacctttactttgaaataactggcaactacactgtaaatcgctatctgcatcgccgtaagtaaagcgctcaccagcaatatccagcaccatctttccattctcactatgaagaacagtcagttttccagcctcgtacaaatcaattccttcttggcgaatccgccctggcatcatgcgacccattctaactcctttatccttcaaccaatcatcagctcttctgtaaaatatatctaaaatattatcttttcattatagcatattttcaatttgaattgtttaaataggtatcaaaaaacaccagcaggtaaactggtgtctctaatgaatagctaaataataaatcgttgcttgccacattttcaagattgtttttccgaatttccaaagccaaaatagggcaaatagcaggaaaacaactgccactactacgttaatcaagccttttccaaccaagaaaaacttgaaaaagaagacagtcacacaagtaagcaaggcaaggagtaaaacatgaatcagaactcccaaccagcccagccaatagcgaattccaaagggagggtgtttcttttcatcgaagtctgctagaccagtcaaaaactcaactagcaactcacccaaaaattccatactagcctacctttcttacctgtcgataatatttggttcgtcgaatcatcatcttgatagccttaaaggaaagtaaggttagcatactagccacgaatagacaaaaaaggaatatcacaaccaatggctgtttatactgattatagaccataattgaaccaccagtaaaggcgataaaataggatgccaaagtcaccaaattgagccagatacaagccactagccccagccaataacgaaagccgaaaggtttatactgactgtcttcataaaatacaagaaaaaatgatgaaaaagaaagcaatatcaaaaaagaacgccaaatcggaaccgctaccataccaacacctccaagtccattctagcatatttacgaataggtgcaaagaaaaaagaggttgccctctttatttccgtttccgtgcaatcagatgaatcggtgtcccttcaaatacaaaggccttgcggatttgattttccaagaaacgcatataggagaagtgcatgagctcttcttcgttgacaaagaccacaaaggtcggtggtttggtcgcaacctgagtcgcatagaaaatcttgaggcgtttgcccttgtcggtcggtgttgggttgatggcaatggcgtccatgataacatcgttgagaacagccgacggaatacgggtattctggctctcactgatggccttaatcatctcaggcaacttatgcaagcgttgtttggtcaaggctgacacaaagataatcggtgcgtaagacaagtattggaactggtcacgaatatcgtcttcccactgcttcatggtatggttgtctttttcaagcgtatcccacttgttgactacgataatcattcccttaccagcttcatgggcaaagcctgcgatgcgtttgtcatactcacggataccttcttcggcattgataaccatcaatatgacatccgagcgttcaatggcacgcatggcacgcataacagagtatttctcggtattttcatagaccttaccagacttgcgcatccctgcggtatcaatcatggtaaattcttgaccttctgggtctgtaaagtgcgtatcaatagcatcacgagtcgttccagcaacaggcgacgcaatcacgcgctcttcacccaaaatagcgttaatcaaacttgatttaccaacgtttggacgaccaatcaagctgaacttgataatatctggattttcttctgcttcctgagctggtaggttttcaatgatagcgtccaagacatcccctgttccgataccgtgtacagaagatactggataaggatcgccaagaccgagtgaatagaaatcgtagatgtcattacgcatttcagggttatctactttattgacaaccaaaataactggtttgtttgtcttataaaggatacgcgatacatactcgtcagcatccgtcacaccttccttgcctgatacgacaaagacgataacatccgcttcatccatggcaatctcagcctgatgcttgatttgctccatgaaaggtgcatccacatcatcaataccacctgtatcaatcagggaaaacttacggttgagccactcaccagtagcataaatacggtcgcgggtcacaccttcaacgtcttctacaatagaaatgcgttcccccgcaatacggttaaatagtgttgatttaccaacgttgggacggccaacgatggcgatagttggtagagccatagctcctcctcttctagtttacaataatttattcttttctaagatagactttgtttctggttgttcagcctgaccaaactgggcaaccatacgctcagaccaggattctgtctgacgggcacctgcataggctgtctgaacttggtcgtaggcttggattacttccacgccttgctccacatattcttcctgaaagacaatggcttcgctttccaaacgtggtttaacaggatggttttgggctggtcgacccaaggcaatacagaaaatgggataggtataatctggcaagttgaacagctctgctattgccatggccttatggcgaatcataccgataaagaccccgccgtagcccagactttcagctgccaagagggcgttttgccctgctaggctcgcatcaacagaagaaatcaggagattctctgttcctttggcatcaaagtctgaaccatggagttgagccgccttgctggcacgattatggtcgcccacaaaaaccagaatagcctgagcctgtaaaatagctggctggggcaccaggtcatagagtgcctttttttcttctccgactgcaccacaatgatggaataagactggaaattcttccagctagatgcagctcgcccagctgatataatagcttgcaaatgttccacctcaatgggctcttccgtaaaacgacggacggaagtatgattcagcatcaaatcaatggtttcattcatcggcggttatttcctttcaaatgcaaatcgcgagccagatagcgaatccgctccataacccgttgggcctgccaggtctcatcaccagacttgccagatgcaaaatgccgttccaactcatcaaaggagaaattggaagtaaagaaggttggcagattttcctgcatgcggtattgaagaatgacctgtaaaacatcgtcgcgcacccacggactatgttgctccgctccgatatcatctagtaccaagacctgagccagcttgatttcatcaatccgctccttgacagagccatctttgatggcattttttatatcgacaacaaaggtcggataatgcagaatggtggtcgagaggtggcgattggttgataggcgatgggccatgtaagccatcaaaaaactcttcccaattccaaaatcaccatatagatacaaacctttatagtgttcgccgacctgttcaacaaaagcatcaatggcatcatagacctctatacgattactgtctgtgaaatctaaatcagcgatagtaacttttttgagagcctgaggcatattgatgagctgaatgcggttcttaatagcttccaaacgacggtattcgaccaattcctctgtttcaagataggacacatctgcatagccctcattcataaccaaaacaggttgatagccttttgcaatataagtctcatcttgtttgacaaaaaggtcacgctgactgatatattccaaaaacttagaaatggagagggtgatttcctgctgagtcaaaccttcttttttgataaaagcagcgacttcaggatcactcactatctcctgatagagttgctgataagattttgaacttggattggttgcctgcgacaacctgtcttgaactgatttcatcagctacctcccttactttcgttttctaacattcgtttcctaagcgcttccattcttgcctgagcttcaggactgttatccatgacaacctcttccttactccactcaggcacattgcttttctgtggctggctcgacttggtaacagcttgacctgtctttaactctcttagataaagaacagctgcctctgcactgccaattcccttgtaggaaaaatcattgcccagcttcatagcgtatttttcatttagattggctgagtccaccttgttaaaggtatagaggaccaagacattgataacttcgtcaagcagacccaaattggccaaatccgtcaagcattttcgttctgttcctgtcaccgctgccttccgttgctccttgataaaggacaggaaggttaggctggattttgatttcgcttcacgaacaatggcttgttcttgggcagtgaggttggcgctttctgttggcaatgactgacgtgactgctgcaagcgtttggtcgagatcatctgtccaatagctgttgctttagcctgccgataggtttccaaccaggtccaacctgcctgctctgctatgtaactaagcgcaataatatcctcagcttcatcctgaaaaagaagcttatctttagccattaatgccttgaaggcagaccagtcaaaatcatgtttcggttcaaaaacaactggagcctgcccatccatggtaaagacctgagaaaatgtttttgaaatattttgttcttgattgggttggtgaacaagcagattctccatacttgactccccaatcttccttgccaacaagttcttatacaagggtttcgctagaaaactttttacggtcagaggggcttgtagcgccaaacctgttaattcatctgcacgatagagttctaggagccccatggcagtcagaacatccagagccttctccaaacgattcatcccaaaatccatgtgattgagaatgacagtccatttgtaacgtccttgcccttgatcggcaaaactataaaagtaataataaagcgctaatgcatcaaaaccgataatcggctggtagcatttgctaagactgacaatatcaggtgtaaacgggctgatttttatataggcaaataaatcatttggtttcatctttttttcccggttttaccttacttcctttggagatcatctgcttaagcaaattttctagctctccaacatctttgaaagaacgataaaccgatgcaaaacgcacataagtgatttcatccaattcgaccaattcttccattaccaaattcccaatgacatcggattctatttcactatcaccttgtgctcgaaccttctgttcaatccgattcaccacttcatcaatatcatcggttgacacagggcgcttttgagcagaacgaataatcccattgaaaatcttttcacgtgaaaactgctctctagttccgtcttttttcacaacgactagagttttctcttcaatccgttcataggtggtaaaacgttgaccacattggtcgcaggaacgacgacgacggatggtattgccatcttcagcctgacgactatcaatgacacttgatttcaaactctgacattttggacaacgcatactctttctcctacataaactttatcacttcagtatagcataaaaatgacaaaaataaaagaaagcgagaattactcactttctaccaataattcatcttgcttcttcaatcgactggcaacccattcacgaaccaagcgatagacaaccgcaaaaattggggtaaagaagaccataccaagtaggccaaacaaattaccaccaatcagggctgcagccagggtaaagagggtcggaagaccaactgattgaccaaccacgcgcgggtaaatcacatttccttctatcagctgaataatctggaaaagggcgatagaccagagtgccaagagcggattttgtaccgccacaaagagagcactaatcaaacacgctgaaaagggaccgatataaggtacaaatgataggaccccagccaaaataccagccatgctggcataaggaattcctgagagcgaataactaacaaagacaagtgtcccaatgatacatgcctcaacaatctgactcatcaagaatcggtcataggtatcaacaataacttctccaatatagttcactactctgacagccttctctggcaaggtagcctgcaagaactttctcgtcatcgcctgcaagtgttccttgctccctaaaatcgctagagtgaagaagaaagccattatcaacgtcatagtgttcgaaaaaatccccgtcacattggacaccaagccagataaaatcggtgtgaccaaacttgaaataagtgttaaattcttcaactgatccaaaaagctggcaatctggtctccgatttgtcccgacaaaagaccatttgattcaagaaaattagtcagggcatttaccgattttggaatggctgtgctgctaaccgaaaccagttctgaaacagtcgtcaccaatgtaggaagaacaatcactaccagtcctgtcacaattaaagcaaatccaattaatactccaacaattgccaaagaccgcttggatttctttaaaaaagaaattttttcaaactgatcttctaattttttcatgggaacattgagaataaaggcaaaaatagctccaataaaaagcgaattcatactgcccaataattgttgaatagccccataaatactagaccagttgagaacagctaataatgtcgctccagataagagtatcaatatgactttttctttaaatgatgtattcataacttttccattcttacttattggctattattttatcacacgcttatagaaaaagaaagagggaaagcttccctcctctctactctaaatcaatcgcgcatggcatatccgacaccacgaactgtttttatatatgaatcttgatgtggcaaatccagtttaccacgtagatagcgaatatatacatcgacgacattggtctcagaagccgcttcatatttccaaacacgctcaagaagttgttctcgactaacaggctctgggctattcattaaggttgccagcagatcatactctcggcgggtcaaattaatcaattcatcacctcgagtcactgttcgattttgaaaatcaaccttcaaatcacgataggccgcatgcatgtgaacctgtttacagttattgtcaataaagtcacgaccacgaaaaatcgcagagatttgctccactaaatcactaatgacaaagggcttcaccacgtaggaaacagcataagagaggacttcttccccatattgactaacttctgtcggctcaactaccacaatcatgaccgtggctggttttatcgctaacagttctgtagccaattccttgctggacatgtctgaaagctgaaaactcatcagaatcaagtcaaaatccgtttcatgtgccaaggacatagcctctttccctgtcgatgcataatcaacaagatagtcttttttttgcaattccatggaaacaaaatgcgagagattgcgttctttaccagcaatcaaaattttcttagccattgtccatccttttctattctttcaaatggtgtaggaatcgtattatgactagaaagaagggcgcttccacgcccatcttttctattttgattcgctataccagtcgtaatggaagattccttctttatctttacggttataagtgtgagcaccaaagtagtcacgttgtgcttgaatcaagttcgctggcaagttttcagcacggtagctatcgaagtaggtaatagctgctgagaatgttggtacaggaactcctgcttgaactgccaaggcaacaacatcgcgaactgcctgttgatacttagctgttacatcaaggaagtactcatccaagagcaagtttgccaagtcttcatcacgtccgtaggcatccgtaatcttttgcaagaagcgagcgcggatgatacaacctgcacgccagatttttgcgatttcaccaaatggcaagttccagttgttttcttttgatgctacgcgcaactgtgcaaaaccttgtgcataagacatgatttttgagaagtacaatgcttgacggattttttctaccaattcagccttgtcgccttcgtatgcaaacggagctggttttggaaggaccttgcttgctgccacacgctcatctttgtaggttgagatataacgagcaaagacggattctgtaatcaatgacaatggcacacccaagtcaagtgacgattggctagtccatttaccagtacccttgttaccagcagcgtccatgatgtagttaacaattggtccatcttgaccttggtcatccttgcgtttcaagatgtccgctgtgatttcaatcaagtaactatccaattcgccttggttccagtcagtgaagatgtcagccatttcatccactgacaagccaagcaagtgctgcatcaaatcatatgactccgcaatcaattgcatgtcaccatactcgataccgttgtgtaccatttttacgtagtgaccagctccatctggaccgatataagtcacacatggtgctccatcttctggtgcttttgctgaaatttcttccaagacatctgccaccaattcgtaagcttctttttgaccaccaggcatgatagatggaccttcaagggctcctttttcaccaccagatacacctgtaccgatgaagttaatacctgagtttgccaattcttttgaacgacggatagtgtcttcgtagaaagtattaccaccatcgatcaagatgtcaccttcatccaagtgcggcaagagcgcttgaatggttgcatctgtaccaggaccagcttgaaccataagcatgatgcgacgtggtttttcgatagatgccacaaagctttccacatcgtaacttggtaccaagtttttacctgggttgcttgcaacaacatcttctgttttatcagcagagcggttgtaaatagctactgaatagccacgtgattcaacgttaagcgcaaggttgcggcccataacggccatccctacaacaccaaaatttgctttagtcatttgtttactcctctaatttgtatctcttttattatacactgaaagcttaaaattgacaagaattttcagataatttaactatcttgccaatctgagttagtcctcatctccaaataacccttgtaattgggcaaaaggactattggcttcttttttctcttgagctttttgttgaaaatcttcttcagtcattaaagcccaagctttaccagatggtagttcctgtccagcttcttcttcaggtgtcaagactttgattggtatagccagtaaaatattatctgctacactctcatcaaggacaatgtggtcatcttctactaccagtaccatatcctcatcaatcaaatcttgttctttaagaactgcttcattggcaacaaagagttcattgacgttttggacctcatgcaaaacaactggttgcagagaacgactggatgccaaggtaatatcataagtcatctgatagtccaagaaaaagaagcctgattcaaaacggacatttccagtgacttggactggcgacaagcctagaacttcaccatttcgagcttgcaattcttcctgtaaatccaaggttttatcaaagaagatgccatctagatttttctgaatatcgtaaatatgaaacattgtattcccctattcagctagttctggtgatgtagttatagacttcttgtccagcaactgcaccatttcctactgccgttgcaatctgacgaagttgattttgacgaatatcaccgatggcataaatgcctgattgggtcgtttccatcttttcattagtgataacccaaccagcttcgtctgtaattcctaggtccgcaactgtatcagtcatcggatccagaccgacatagataaagacaccaccgaagtccagttcgctgacttcctctgttttcacatttttgataaccacgctttgtacacgtaagtcatcgcccttgatttcttcgactacgctatcccagatgaagttaattttttcattggcaaaagcacggtcttggatgactttttgagcacgaagctgatcacggcggtgaacaattgtcacagactccgcaaactgtgttaagaagagagcttcttcgaccgcagaatctccaccaccgacaaccaagagtttttgtccacggaagaaggcaccgtcacagactgcacaatatgagacaccacggctattgtaagtatcctcacctggaatacctaacaaacggtgttttgcccccatggctagaacgactgtctttgtctccaaaacaccatcctcagtaatcactttcttaatttgtccttcttcctcaatacggactagggtgccaaaaatatggtccacaccgaatttttccaagggttcaaacattttttcagccaaggctggacctgaaatatggtcatagcctggatagttttcaatttccgcggtattgttcatctgaccaccataaataccacgttccaaaagagctacctttaaattgctacgccctgcataaagagctgcagtcatccccgcaggacccgcaccaattacaactgtatcgtacatatactttttccttctacgctttaaacattaataagattcccactactccaaaggctgcaatgggaattgtcatcacattaatcatcaacaaatcaaacaagaaatcttgtcgttcttgcaaggttttatccacaccctttgtcgcacgccagataaaccagaccagactagaagtgataatcaacaaggaagctattagcaatccttgtaaataaaaacttagaatgttttgtaacatctttttcctcgattactttaaaaggtttgacgcttggctttacgttctgcacgaccctttgcacgcgcttcaactcgcttggtcttgcgacgtttttcatcaacagcccattgaattttcttcttgtagcctggtttgacttttttctttttcttcttgaccaagccaatcatttccaaatctagtttttcacgagatttttcacggttagcacggcggtcacggtcgtaggtatcgacaaattcgccatttttcatttcttttggcaagaatttgatattgagtttttctagctctcgaatatctgcatcatcgcttggctgataaagggtaatggcaatgcctgataaaccattacgacctgtgcgccccacacggtgaacaaagaaggaaagatcctgtggaatggcatcattgatgacatgactgacgccctcaatatcaatcccacgtgctgctaaatccgttgcaacaatgtactgatagtccaagttcttcacctggttcatcatccgcttgcgctcacgtggaggaatatccccatgaatctttgcgacacgaagaccgttcgcagtcaaatagctatgcaattcatctgcacgtgtctttgtattgacaaaaatcatggccaagtaaggttgcatgagcttggttacttccaagatttgagcattacggtcacgccccttggttgaaatcagccagttttcaatggtatccgaaatgaccgtatgggtcttgatttgttccatgactggattggacaagtattttttcaaaaacggttggagtttctgcggaatggtcgctgaaaagaccataaattgcaagtcttttggcaggctgccagcaatcttatcaactgtttccaaaaagcccatgtccaaggtcatatctgcctcatcaaccacaaaggttttggctttatggatagcaaggtcacctgatttgaccaaatcatagatacgccctggtgtcccaacaacaatgtgaggctgactagcttgaagcttgtcaatttgacggttcttatccgtaccgccaacataattggtcacacgaacttctgtgtccgaatgactagccaactggcgtgccgcttgataaatctgagtagccagttcacgagatggggctgtaataacagcctgaacttggtccaattcctcatttaatttttgaaaaatcgggatcaagaaggtatgggtcttacctgaacctgtttttgattcccctatcaagtctcgccctgacaaaacaacaggaatcaatttctcctgaacttctgtcggctggacaaagttaatttctttcaaagcctcctgaatataaggcttgagtttcatatctgtaaatttcatagtttcctctttagttgtattccctctattatagcacgatttaggtggacaagcaaaaaggacggatacccgtcctaatcaactctcacttgcttcagtaaattctgcctcaataattccaagttccttctcttcttccaaacttgctttaaaggcctcagtgagttctaattcgccatcaaaatcaccatttatttttttcacaaatgtgtctgccaacatccctcccatgggctggaaggtaaaataggtcaaacctcctgaaatcagaccacccaaaataggaactgcattggcaatggtcttttcaacagtctttttggtaattttcacaccaatcactgcggctacctttttcaccaagggataccaagttgtcttggtcaaagcctgcatagctacttttttaccgatattagctccgactgtcttggatactttattgagaagaactgctgaaccacctgctccaaacatgacaccaatgtaggcaataatgcggatttgaacctcttctgaaatttccttcccttcaccaacaaataattcatcttcaccaaaaagataagcgatttgttgcgacaaattcaaggcaaaaccaaaatactgagctatatcagcagtacctgccgccaccgctgtaaatggattccccggtaaaccagctgcgaaagaaatcaaagatgttttcgtagtcatatcattaatgattttttcagcttccttacgcaaagcttttgtagtgaagaccgccgttggtccatccgcaataattttatctagatagggactatctttaaaacgagtcttcaaaaattcttcccgattgactttaaccataggaagttgactagcagctgtcatggtttgaataaccactccatataactgttcttgattgaattgttccatttttatcctccaccaattctctctctattttaccccccccccccgaccatatttgtcaaggtaaaaaaacagcatttctgctgtttctgacattttatagataaagaatagctagggtaatcaagctcatgatgagaccgactgaccagaggaaaaagtcaactttccactcgctccatttttcagcttttccggtcaaacctccaagctccaaatggtgatgaaaaggagtcatacggaagatacgacgaccttctccaaagcgttttttggtgtatttaaaatatgaaacctgcaacataacagaggacgtttcaatgacatagaccaggccgataaggaggagagtccattcctgacggagggcaattgaaatagttgccaacataccgccgagagccaagcttcccacatcccccatgaaaatcttcgctggtttacggttataaacaaagaaaccgagcaagccaccaatcatggtcacacaaactagaagaatatcaaatttttgctcattgaaggcgatgacagagtaagctagaaggctgataacaactgagatagaagccaatccatcaatgccatctgtcaaattaactgcatttgaaaaaccgaccagccagaacagaacaaatgggaaatagagaactcccaaatgtaccatgtgaccaaatacattcaattctccgccacctgctcctcttacgtggacaaagtagaagacaatacctcctaaaatttgtagagcaagcttttgtttaggattaagaccttcatttattttacggaaaatttttaaaaagtcatccaaaaatcctactacaccataaagggcaaggatgaagaggatggcaaggacaccacccgtcaacagttgaaaggccgttgcaaacaacaagctgacaagaatcgcaacaacgagaaaaactgttccccccattgttggtgtacctgccttaaactgatgttgtttcacatcttcgtgcatctgttgcccctcaatgcgtttggcttgataaaatgtaataaatcgtgggattaagagaacggttgctagaaaagctaccaatcccgacataagtgcgaattgcatgtcagtctcctaaggttattgttattttcttggttttattcaaagcggtaccgacctctacactttggtcgactacttttgaacccgttcctttataggtcacttcgataccagtccattcagcaaatatatccatattctctttggtgattgcgtacaagtctggcatttcttcgaatttatttgtcaggagtagaacctgttggttggcgattaccttacttcctttttcgactgaaacttttttaatttcagcaccgtttccaaggataactggttgaactaattgacggcgaagttcctcagccgactcgcctggtgccttaccaatgaggtctggcaattgatactctgtctcattagcgacccgtgccaatgctggtgcaggtgaatccagattcaaattgtctttcaacagcatcgcttctttcaatgtaggactgacaatgtcacgccaagacaggacatttaatacttccggttggcgaatggtcacatacatgataaattcagggtcttcagcagggatcatggctactacagagttgatgtaggcacctttaatatacccttgaccatcttcgctggcaatttccgccgtacctgatttgactgcaatatcatagccgtcaacctgaattgcaggcccctgtaagtcatgtgagtagagcgtaccataaacagggtcagtaccgacattaatcatatagcgaagtgtatcgtcggcagcttgttcagaaactggatttcctacttcttctttcgaagaaactctagctgtatctgtattaggatcataaagagctgagataaatttaggctctagcataataccattgttcgcaatggcggtaaaactacgaagcatctgtgcttggtttgcagaaatcccctgaccaaacgatgacatggcgatagaaacaatgttatcctctggtaccattcctggcgcctcgtcccccataccaaaacgcgttgggtagccaaaacggaacttagtgaggtaatttagccatttttcatctcccatctgttgctgcaataaggtcatcccaacgttactggatagggagaagccttgcgcataattgagagtcacagctgaataacctgcattgagggtccagtcattgattttcgcgtctgcaataacgtactcattattggtataatatgcatttgggtcaaaggtgccgttatcgatagctgacgctactgttagcaccttcattgttgaaccaggctcaaaggcctcttgatataagagtgaccgctctagcagtccttcttgtcccagaccttctttggtatctgaatcatagcttggcctttgggtcgtcgccagtatttcacccgtcttggctgaaaccaaagttgcattcgcatatcgccctttggcgttatcaaaaaaggtattcatattggtttcaagagaacgttgtagatcggctgaaattgtcgtatagacatcctgcccgtttactgtctccgtttcaaccttttctgtcccaggtaggacacggccttgactatctttctcgtagataacctttccgtcttgaccagccagaatatcattcagataatattccaaaccactcacaccctgtaaactatgactaccatccttgttttcaaccagattagctaacccgacaaaaattgaagcaaaatttccattcggatacatccgtcctggactagcgttaaaggcaatcccttcaatacctgccgccttcatctcttcttggattgacgacattgtactataggagatattcttacctaaggtcccaaagtatacctgcttcagttcaggttgattcagctgctccataacataatctgtctccattccgagatgctttttaaagatttctgctactttgctgaactgagaagactgcacatacaaaacttttttcagttctgacacatattctgtgtcaatgatggcatagactgtataggtcgttgaatcttccgcaataggaattcctgtacggtcgtatatcgtcccccgtttagcttgaacgataacttcacgctggtgtaccgcatcagctctctctgacaagtccaccccaaatttactatcggtgccgataatataggcaaagttgattaaaaagagaaaaaagacgaaaaccgtcaaaagaagtaggctctgtcctactcttcgacgattttttgacggaacatatcgttttttcaagacataccgcaagagtttattatttcttctgggcattattcggctactccaatattgtcattattaaaagttaatccagctttttcagcaatttccatcaagcgagctgaacgtgtcaattcattgacagcttgcttagcatcgttaatttcaatctgtttttggctaatgtcttgattgactttggccatgctagattgaagttgcaaaagccgcgtttgcataaagataattcctatcgcaagggctaatccagataatacgatgcttgaatagaaggctttttctacacgtgtgaaggttctaattttatcaccgataacccgcatagtggcttctctacgtttttcttgcaacatagactctctcctatttatgtactttcttagctacacgcagtttggctgaatgcgcgcgattatttgcctctaattcttcttgactaggtaagataggcttacgattgaccaattcaagtggcgccttcaagtcatctggaataaatggcaaaccttttggaacatcaatcgtacttgcttctttgaagagttgtttggtcaaacgatcttctaaagaatggaaagtaataacagaaatccgtccatccaaagccaataagtcaatggcctgctggatagattcgtctgctgcccccaactcatcgttgacttcaatccgaatcgcttggaaaatctgcttggcaggatggcccttcttcttaagttccttggctggcttggcagatttgatcagctctgccaactcagtcgttgtttcaatcggcttgaccgcacgcgcctgttcaatcttacgagcaatctgcttggaaaatttatcctcaccgtatttaaagaaaatccgtaccaagtcgtgataatcatagttattgaccacatcataagccgtcaaatgtccctcacgattcatccgcatatcaagcggagcatcttgtttgtaagaaaagccacgctcccgctcatccaactgtggactagatactcctaaatcataacaaatcccatcaatctctgttacacctagctccgccaagcgagtcttgagattacggaaattatccctgataaaggtcacttgtcccttttcaatgtaggatgccaagcgaatatgggcatgatcaatagcagtctgatcctgatcaaaggcataaagatgcccaccatccgtcaactgactgagcaggtactcactatgacccgctccacccagcgttgcatctacataaattccattgggtttgatgtctaacatatcgactgtctcatgcaagagaacagttgtgtgattaaattccttggtcatatcttttccattgtaccacaaattaaaataaaaagttgttgcaaactttttacaaaaaaactgtcaaatatagttgacaacttatatgaacaggtatatactaacagtaaagaaacatgtcacatatagttgacatcaacagggaggtctcccacatttttttacacttgtatgtcggatataattgacaacaatttaaaaggatagtcaacctatcctctcatttttagccaagtatgtcagatataattgacatagaaaggagggcacatgaaccgtgtcaaagattatcgcctattgcttgggatttcccagctggatctggccaaggctatcggcgtatccaggcagaccatcaatatgattgaaaacaacaagtacaacccctcgctagacctctgtatcaacctagccaaagctttacagactgaccttaatagtctcttttggaatcaataaggagttcatcatgaaagatatttttacaaaaattctcaatcaagcaaccaaggatttttattccattagtggtcccatggatgaaatgcgtctgcaagaaagctatcgcctcagtaacaccattgtcatgattgtttttcctatcctgctaataggaaatacgattgcacttcttattgccctacgacaacctgaaaaagttggctttctgctccccctaaccaatatactaatcatcggtttcacgcaagccttagcttcccaccttgccttgaaaaatggcattagtcaaagctatgaggatgaaattaatgtgaccaagctcaataaatctcttgtaaaaagtagtcgtagcacatttttcggagccttcctggcttccacgactgcccctgctttctataaagaatggtctgtatttcttgaagaactaacagacccgaccctcctactaggtcggttaattgttgcaggagctatcaccttcatccattactactattgtaagaagcagttacaaaagaaaattctcgcaaacaaataaaaggaagaaaaaccatgaaaaagaatatacgtcaagctcttatctctacccttatttttatcccgctctttgtcctctttcagctttggggcaatagcggagcagaaatcttgcacaccatcagccaagcaaaattttggctacaattgctgattgctgggaccatctacttcttaggctttgtttacatcttaccattgttcgttcaaaaataaggagctgcttatgaaaaaagaaacctttcaagataaattaatcaaacgattttacggtatcgcaggacccttggatgaatttcgccaaaaagaagcctcccgactaggcaatacctgctttatcctgctcttttggggcaccatggctcttaccctactggcactcgctctatccaaacgctacccagaagtcgttgcctatggctacccaactgctctactcctatccactctttcctccagtatgtatatgacatccaagatgcgccacagccaagtggacagtttagatgtagaggaactgactaccaaggaacagaagcagctcaagggagcaagtatcaaattcgccctctatttcactgccgttatgtacatttggactgttgtttttggtgcctggatggaggggctcaaccctttcgaccacctatttgacctccgaaaattccttgcagcctgtctaggtggtattttcacgggcattgctcttgaaatcatgttacgcaagcgcatgaaaaaggcagaaaacctaactatcagctctgctatttcaaaagaagaacccaagtggatcaaaaatatgattaaacgtttttatggtatccgcggtcctttagacgaataccgacaggccgaggctgatgctatcggcggacaggcctttatctactacttctacttcctagctcttggaaatgccatcgcctacttcctagcctaccgctatcctgtggaggtggctgcctactatccaatgataattgccttcttcagtattatcctaattggtatcgttaatatgcgcaccctccatgctgacctgcctcaatatgacatggaggaactaagtcctgaggaaagacaaggacagaccctcaatccactcgtttggggactgggtgttgccctgctatctagcctctttgctgggctgtcagacctctttagcctccagcttcccctactggcctccagcttccacgtcaaatccctcctcttcggtggtatgatgggcctctttgccagtctagccctgtctgcccttgcctatctgcaaaaactggaagcagatactgccaagaaaaaataaggagcagacctaatgaataaaccttttacacccaaacaaacctgtcgattttttgttctattttatgctttattttctgcattcttcatctactcttacatggtcaatgagccgattagcggttcattcttgctcatgttaccgcccattcagattatcagatcctttaaaacagaagaagaaaaacgatactttatcattcaagccatctttgccctgtttgccatgaccttgacctattccgtgggcatttggctaggacatgtcaaaccacatatcctcatccttcctgctggatttgctctggctattctttatcgattgtatttcaaaaaggagaaaacagatgaacgttaacaaaccgaaacttatactcactttgattgttctctcctatacaacattttgtagcctgtatatacatagctacctgactggggacaatccaccaatctttatcttaccgttcactatacttccaatcttgaatagtgactggcaaactaccagtccagaatcaaatgctgtccaagaagctatccatctttatcgtaaaccactgctatgttttctctttgcaggtcttgtcctaaccttctccattggatttttcactggtcaaatcaaaccactcctagctggattttggggaatatttgctctcctgctctttattggacaattgaaaaagtagtctgtatccaacattttacaaagtaggattttttctataaaatagattgtatatgacattcaaatccattctcaaacaactcaaactatttgattatatcttaatcggattcaccctagttttatcctttcttccagcaatttttacctacacacaactgacaacagatgcaaatgaggcaaaaacaattgcctatgtccgcatcaatggtgaggtggtcgaccaatttgaattatcaaaggacacaccccgtcaagaaaagacctactatcccaatgaagggcaatacaatatcattgaagttgatggcgaacgcattcgtgtcaaggaagacaatagcccagaccaaatcgccgttatgaccagctggattagccagccaggtcaactctccgtctgcctgccacataacctgttgattgaaatcaaatccgttggcggggaaaacactgacgaagaagaacttattttaccactatagtcttttagtttacttttagtactagctccaaaggtttgggaaatctttggaggttggagataaagcgaacaaagttcgcatcaaaagccgcaggcataactcaatgctttcttatttctaggcattgacttgaaacagtcccccagactgtttcaatcagacaaggcgagttcaaatactccagtggagtgtttgaagttggaaattaggaaacgatgtttcctcgctcgtcgaagtaataaaagaaaaactaaatgacgatataacaaagaagacacagcctgatgaacgactgtgtctttcctttttagaaaataagggctaaagcaagtatcaccacatatagcagcgcaaagagtacaaaactctttactgcctcgataaaggtttcccgtttgagttgctttttcaaaaatgtttctagactcttataagcaggccaaactccgattaaaccggccaatgcccaaattggtaagaatcctatcagacagtagattatccacagcaaccatggtaaacttgccaagacaaaatacaatttaagagcatttttcttgccaatatagtaaaccagagtataacgatggttgcgaatatcttcttctaaatcacaggtgttgttagccaacatgatattagcaatcaaggttaccagaggaatggacatgaaaataatttcaattatttttatccaagaaaattgcaaagtcatccactgaccgctcacttggctggtcagtagcaaatctggttgctgaataaatacagcaagaaagaagatgccaaatcccatggttactccagagaaaacttcacccagtggcattctcgaaagcggaataggtccaaaggtatagaagataccaatgaggaaacagagagctcccatcggtaggaggagccaactggtccgccatacaaggagtaatgaaaccagtagagaaaaaataagtagagcaaggacgattccaatcatctgacgaaaatctagggagaattttccaatcacattgctttcctgacgataggcttcatccttggccttgtggtagtccatgctattgttgatggcagttgtacacatgtcaaagctaaggacggcaataatgaagaggagagtattgagccaattgaaagcttgatagcgatacaggctccataaaatccccagggtcatcggaaaaacactagctaccttggtcttcatttcaacaaattctagaaatacagacaaactgagccctttagttgatttattcattaacaagatgatactcctcattcgttaattcaaagctttctttcaagccatcactcagatgaacgccctgctccttatcgataaaaacagcttctacaccgtcaatctgattgataaagtcaagacctttttccacacctagtaagaagagagttgtggagaaggcatctccttggatagatgttttggaaaagactgtcacacctgagatatcgttttccacaggatagccagttttgggatcaaggatatggtgatatttgacaccgtccacctctaagtagcgctcataaatacctgaggtaacaaccgaatcatgtgtccctggcacagaaccgaccgttgatccacgcacttggtctgggtcttgaactcccacattccaaccattttgtgtcgttggcgaatcccccataaccactacattcccacctagattaatgatggctgtcgtaatccctttgcttgcgaacaattctctaaccttatctgcaatataacctttggaaatggctcctaattctaaggtcattccttctttgataaagacagtcttcttctccttatctaaagtaatgtctttataattgataaatggcagagcagctttgatttcttcatcactcggcttacgtgcatcctcatctccaattttccacagattgctcacagctccaatggaaatgtcaaatagcccctgactttctttactcatgtcaatagctgtttcaatcacttcaaaggtacgttcatcaaccttgacagcttcttttcctgctgcctgattgatacggtagacatctgccccttccaagtttgtggacaacagactttccatctccttgatataggagacagcttcatccatcgcttcttcctgattttcatgataaatactcaactgcactactgtgtgaagtaagctttcactacgagtcaacggagttttcacaacagataaactttcgttttgtttaccaccacaggcaacaagcaaaaccatcagtaggcccacgaacaatagacttgcaatttttttcactgattttaccttcccccaaaaataagaagacacagtagccaaacaagtgcgactgtgtcttttctgtatagacttaattagtcaagttttacagtttctgtttttccttcagcagctgctgcaagaagggcttctgtactcttcttgaagtcttcagaagtatgagttgcacctgatacaacttcaacagctgagaggtcttgtttctcaaccaaagctgcattgagttgttcgattgcttcaccagcagaaactccagctttatctttcatgtttttgttgtactcttcatttgctgatttaagacttccatcttcagcttcgtagtcaaattttgactcactgatttttccgtctttaacagtcaatgtgtgaacaattttgtagccataatcgtctttgcctgactcagctttgtaagtaccatctttcaatactactgtttctgtagttgaagatgaagttgaagtagattcttgtttagaaccacaagcaacaagtgcaaataccgcaccaagaactaccaaacttttcaacacaactttagttgttttcataacaatactccttttgtaaagtaaatagttttatacttataatgatataccgaataaactaaattgtctagtatttttttaaaaataatgactaaaaactattgccaccaaattttgcatagacgcagtcgataactgtgatattctatctacaaaactcatcattttttccaaatagctaacaatcagtttctctgttttggcaatagcatgcgttgcaaaaatcctatctgtaaggatttccaacccttctgccgtaggggattgaatataagcccgcaattgctgctggatagacttgtcttctcgcatggcaaaaagtagcggtgcagtatagataccgttttgaatatcttgcaatctaggttttcctgattctgccacatccagctggtagtcaattaagtcatctcgtaactgaaaggccatgccaagtgcttgcccagaccgaaaagccatgctactgtctttcctagattggcctggtacaaaactccccaactgacaggcaagtccaaatagaaaagctgtttttccttgaatttgcttgagataggctttcatagtcatattggcatcaaattgattgagtagctgagataattcccctcgaagaattgtttccatcagcttatcattgcccaaatccaaatcatcacgtgacacctctagcaaacgaagcccctttccaaatagtcgacttgaataggccagaagataatcacccgtgtagatagcgattcgattcgaaaattgttgatgagccgccgtgactccccgccgtttatccgcgccatcaatcacatcgtcatgaataagagtcgccagatgcaggacttctaaatgggcagcaaaatatagctttgaacggctaatctttccttccgtcatttgtgcaaagagcagacagaggccggcacgcaggtatttccctggcgcctctacatattcaacaatcttcgctgtaactgctggatgcaggaccatcatctcagataagatgatggattttacctcttcaagtcccctctcaatctcaggataggtattccaaatttgatgtaccactaactttctatatttcctttattttttatccttgatacggtaaatatgcttcggctttccataaatcttcttatctaggaaacgacccaaccatggcataatccagtagtctagaccgaaggctctacccgcaccattcataagagaaatagctgctgggatgaaccaaatatttacccagtagaacatgcctgacaggctgaacataactaccaaagcaacggttgcagcagatacaatccatacaaaggcaccagcaatcaaagccagaccgataccgatttctgctactgtcataaatttttgcataaagagtgctacttcttggtttggcatcataaattccatgatagtagcaaaccaatcaggcattttgtccaaaacagccatcggtgcttcaccataagcatagctcaaaccaaaaattggttcagctacttctgccgcagcagttgccgcttgtgaggcacttgaaaccgcctcagcagcagatgctccagatactggatcagctaaccaagggaatgggaagacaacttgatccccaaaccatgatgttgttccaaatagaccaaaggctttcttgataccttcgtagagccatactgaaccataaaggacacgcattggcacagaccagagaagatttcctttgcctgaagtatgaccgccaaaaatgtttcgcttattctgaatgtcaaagaattcatgacgaacataagaacccatgtagaagaaactacggatagtaaagaagtagagtaggtttaccatgtgtttgacagccattgccataaagcctgacatgtggtatttgtccatcaagaaggctacaccgtagcgtgctccaatagataccataaacccatcatatttacctttgtagctatgtttttcgccgcccttgattgctgcaataatattacttgccgcagtatggcctgtctgttcagctgcttgtacaatctgtggagttggttttccttctgattcttcaaagtaaaccaagtcgccagctacatagacattttccttgcctttcgcttccatgaactcattggctatcaaacgacctgcacgtgctttttcaataccaaattcacttgcgtctgtattggcttgaacaccagctgtccaaatagaggtataggtaggaatttgacgacctgatgaaagtgtcaagctatcttcttgtacacttgctacaccatcgccaagaaccaattcaacaccttttttctcaaggtatttgcgagccttgacttgctctttttcagtaaccatagccaagatatttggcgttgcctcaacaaccttaagtgagaattcttttgaatccaacttgaactcacgcgccaaaattggtacccagtcaatcaactcaccaatcatctcaatacctgtgaagccagcaccgataacagtaaaggttaaaagagcgcgacgtttggcttcatcatgctcacgcatggcacgatagcaagcgtcaatcatgtggtcatgcaaacgttctgctgcttcgatagaccaaagtgtaaaaccgtgttctttaacacctttcacaccaaagtcattagcctcaccacccattgcaaggagcaggtaatcaaaatccagagtttggtgttccgcaactacttgtttcttatcgtagtcaatctcaacaaccttgtctgttaccaattgaacctttggatattttttgaagatacgttgaaggtcatacttgattgcattggcttctacacgcccagccgcaacttcatgcaactctgtcatataggtatggaaagagttcttatcaatcaaggtaactgttacatcttgatcctttttaaaagtttttcctagcaatcgagctgctgcaatccccgcataaccagcaccgacaatcacaatatttttcgtcacaatgtttcctccttgtgaaaatcaaaacaaattacatgtttccattatatcgtattccaagatagttgacaagcaaatttcaataattagtaatatacacaaacaaaacttgccatagtgaacaaaaacaagtatgatagtaaaatagataatcgactagaaagagttttttctctacacccatgaattctaaacgtcaaacacttaactttattacgatgctagcagctcaggcagttgtcatttctttgattgaacgactcatcacccccccatttgcttttgctccaggcgccaagctaggactgggaaatttgattagcttaattgctatttttaccctccctacaaaggatagcctaaaggttgtcgcactacgcttgctcatctcaacctttctgggaggcaccttttcaaccttcctctatggctttgccggaactactttgagttatgtaggaatgctctctgccaagcagctcggtccaaaccgtgtcagtcctattggaatttctattttgggcgggatgttgcacaatcttggtcagcttcttgtttttgctaccatcgcccgttctttctatgtactgaactacctgccaatcctcgcttttacaggaattttatcaggcttattggtcggactggctgctacctacctcctccaaaaggtcggacctttacgtcactatcatcaacaagtcttagcagaatggaaataaatctccctaggtcaactaaggagattctttttatggtccgcaccactttttcattgtccataataattcccccataatcctggtgtcacaaatataatgagccacctcatataaacaccacttataaaatccatggtaataaaaaataatgaagctttcaagaagagaaaaaaatcaggttctttgcgtgttttagtcgtacattttctttcttttgtgctacaatatcttcatcttttatttttttgagaaaaggtagaattatgtcaccatttaggatcaaactttctcccagtcagcgaatcattatcagtttcttattcgtgattctgactggatcaattttactaagtcttcccatctcacaaattagcacctctacagcaagttattgggatcatctcttcacatctgtctccatggtttgtgtgacagggctatttaccaaagccgttgctgaaacctattctacttttggacagattatctgtatgatgttaatccaaattggtggtttgagcttgataggatttattggtctcttcgctctacgcggtggtcgtaaaatgaatttcatcaatatggcgaccttacaagaggctctaaaccgatctgacacaaaatattttcgtaacttcctcaaatcagcttttggttttaccttggcggtcgaagcctttggagccctcttactgtcctttcattttgtacctgaatttggatgggcgagaggtttatttacctcgattttcgtagctatatcagccttttgtaatgctggttttgataattttggcgcaactagcatcatgcgctatgtggataatcctctaatcaacataacattagccagtctcattattatgggaggtcttggattctcggtttggtttgaccttcagacacaaatcgggcaaaaacgtagcctacgaaaactagggttccatacaaagattgttctaggcctgacagccattatactgaccctcggaactctgactaccttactcaccgaatggaacaacccttctactatcggacaactatcatttggccataaattattagccagctttttccagacggtcaccatgagaaccgctggttttgccagcatcgactatacgaaggctgaaccaatcaccctcttgctctatatctttcagatgatgcttggcggagccccaggtggaacagccggcggtattaaaataaccgccttcctaaccttagtgctctatgctcgtagcgagattctcggtctccctcataccaactttatgggacgaaccatcgataacctcagcatccgcaaagcttttgcgacattctcagtcttcctacttatgtttatcatagggctcttcgcacttgccctaacagatgaccgacaaccacttctatttttaatgttcgaggtcatgtcagcattagccactgtaggtgttacggcaaatctgactccaagcctaaccatggccggtcaagcagtcattatggcgctcatgttcttcggccgtatcggtccactttctattctcgcaagcctttctgttcgaaaattatctaaaaccgaaagtcttcaatacgcaaaatcatctatgcttgtttaaaaggagaaatcatgccaaactatactatcggaattctcggcctgggagtttttggtactaccattgcaaaaacattacacaattacgattgcaatatcattgctatcgataatcatgagcaacgtatcaatcatctagaacctattctcacacgcggtattgtcggagacatcaccgatcgctcgctcctacgtgcagcaggaatcggtaactgcgatgctgttgttgtagctactggcgaaaacttggaatccagtgttctggctgtcatgcatagcaaagttctaggtgttcctatggtcattgtcaaagtcaaaggaacaactgcgaaagaagtccttcttcgtgtcggtgccgataaggttatttctcctgaacgtgaaacaggtatttctctagcaaaacaactactccaccgcgatacaaccagcctctttgagctcgaaggcaatgtttccattgtcgagtttcacccgccagtaaaatggattggaaaaacactcggcgaattaaaactccgccaacattataaactcaatatcatcggttaccgaagtggcgaaaatcaggaattaaacatccaactgactcctgactatgtcttcaaatctgacgaactcatcttagcagtaacagaccataacactgtcgatcattttgaagaactgacaaattaatactcaatgaaaatcaaaaacagactagctccaaaggtttggggaacctttggaggttggagatagggcgaacgtagttcgttactacttacgcagatagaaccctgttactattttgtttcaaggtaacaggctgaaaggctccactggagcctttcactcatcaaatcaagtcaacaacgtctgattttgattttcgaagagtataaataacaaatttacgccctatactccgttttcaggagaaatattttatccctagaaagcctactagactatcatttatctagtgggcttatcatctgtcaaaaggagagattatgaatgatttaaccaaaggaaagccgattgcagtcatcttacaattcgctattcccttattgattggctctttttttcaactggcctataattttgctgattccatgattgtggggcatactttgggaaaggattcctttgcaagtgtcggttcgacagccagcctgatttttttaatcatcggttttgcccaaggtgttaccaatggattaaccattatttctgcccaacgctttggagctggcgacttagaggggcttaaaaaatcttttgtccacggactcttctacgcttccctcatcagccttttactaacagtctcagccttagcttttttgaaacctatcttggtcttaatgcaaacgcctgtgagtatcatcgaccactcccatgcctttctaacggccatgtttggaggattgacctttactattttctataattttctttcttcagccctacgcagtctcggaaactctaaaacacctctactggctctagttatcgcttgttttatcaatatcggtctggattttttctttatcttagttatgaactggggcgttttcggagctggctttgcaactatccttgctcaagcctgttcggtcctctttcttattttttacattatccacaaggtacctcactatcatatcggactagctgatttaaaattggatagaggtaatctcaagaaacatgcccagcttgcttttccaatgggatttcaagccagtattatcgccatcggagccatgaccttgcagtttatggtcaaccaactaggaacagacgccatcgccgcccaggccattgcccttcgtactgaccagttggctatgctgcccatggtcaatctgggcttggctatcgcaacctttactgctcagaactacggtgccaagctctatgaccgtattcgagaaggagtgcgccactcattactcctcagcattgcttgggccattgtatttgcggtcattctcatcttgggcaatcgcttcttctctggtctctttctgccaaatgccagccaaacagtgctggacttggctcttgtttactacatcattaacggctcttgttactggattgttgcttccctctttattcttcgtagctttattcagggacttggcaagggctttatcccaacactagcaggctttggagaattgattttccgagcagcagtcgccatcatcggcatgcagtatttcggtttttatggaaccgccgccgctaaccccgccgcctggatcggaagcatcatcgtcctgattccaagttccatcatctttatgaaaaaattaaaagcaggacaaagtatttagaaaagaaaacgcatgaaactctcatgcgtttttaaaatagtattttcgtaagaattggatatgaaggacattccaaagcatagcatagctgatcgccactacaaaagctaagccatattgccaattaaattccaacacaaggctaacaaaaaggaatattcccagaaggaccaataataaactacttgcctttttctcatccctcttaaaataagccaataaggctttatcaggagaagctttcacttccttgaactgtttgaaactagcaccaagacttgctcctgccgctcctataattgcaccagaataatagtgtggaaggacatagaccgacaaataagcgaccgtaacataggcaagcaccaacaaggcatacaccagttttttcatgaccaacctccctatctatttgtttccgtccctattttaacataaattttatcgtaaatacaagtcaaaataatctactatggcaattgactttctaactcaacttctgtcaagagcgggctataataatcctgctcatcagcctagagcgggctgttgggtagcattttttagtctgagccagagattttttcaaggctttgctatagtcaaataaagagcttttagacaaggaactgaggtgcaggtagttagaacaacctctaggctgttctagcttggaaataagacttgcgaaacaagtcactttcgtagagtatggcaagctgaaagtgacgatgtatcaaagctaattcaaatgactatatctcgagtgattcgttattgtaagtaggctgcaagcacaaaaaaagactagaaaacctagtctttccttgtttattatcatttattcttaggaatttggatcatccaaactacggccatgcaaacctttttcacgttggacttgacggagtttctctggcgtcacatcattgccgtcttcatcgacgaccttgataccttcgatgtgggcacgcacactacggcggtagccctcgatgtactcctcacgaagagctgcttgttcctgcaactcctcctctgtcaagccttccgcctttttcttgcgggccaattcattgatgcgatcgatttttgcttgttccataaatgcctcctacttgctattcaagagattgaagaccgccacagcacttgccttatccgccaaggctttcaagagagccaagcggtttgctttgactgttgcgtcatctaccataaccatggtattgtcgaagaaggccgcgatgactgggctgagagcaaagagcttgtccaagttgcccgccatatcttctgtcaactccaagcctgccactgcagcagcaagggctttttcctggtcgttttcgaagagggcctcgtcaatcgcagtcacctccgccttttcagccaagttgaagacacgtgacaagttttccacggcttccttgtagtcagcctcttttgctttttggaaaatagcagagctggctgccagttgcagtctgaccacaaaagttgagctggcaagtacagcctcgcggatgtctttcggaatggtcttgtccatcatcttctctacacgagcacggataaagtccataacagctggctggttgtcataggtcaagctagcaaaattcaagctgtagagctccgcaatcaactgatccaatggaatttcccaaccaaatgcttccaaaatccgcacgataccctgtgttgcacgacgaagagcgtaagggtcgtttgaaccagacggaatcaagccaactgagaagaaggataggagggtgtcaaacttatcagccagtgccaggaccgcaccgaccttgctctcaggcaattcgccttctgctgagtttggcaagtagtgctcacggattgccgctgccaccgcaggtttttcccctgcaagaagggcatacttctcacccataatcccttgcaattcatcaaactcaccgaccatgcctgtcaagaggtcaaatttgtagatgtccgccgcacgcgccacatctgctttttcacccgcagacaaacctgccaagtcagccagtttttctgcgataactttggtgcgttccatgtgctcgtaaagtgagccgattttctcatggaaggtcacaactttgagtcgctctaccaagtcagcaatcttgagtttttggtcctcacgccagaagaactcaccatcttccaaacgggccaccaagactttttcgtttcctttaatgacattgtcaaggtactggtcattaccgtttcggacggagatgaagtttggcaaaagcttgccagccttatcccgcactacaaagtaacgctggtggtttttcatggaagttaccaaaacttcttctggtacttccaaatatttagtgtcaaaagaacccatgaaggcagttgggtactcgaccagattgagaacttcgttgagcaaatcttcatcaatttcaactgtcacgttgtgtttgtcctcgatagccttgatttgctcgacgatcatattttgacgctctgcggggtcagtgataacaaactgtgcacgcaagtctgcctcgtaagaatctgcacttgcaatctcagtttcatttccaaggaaacggtgaccacggctgatgcgaccagatgtaatgtccaagaagtccatatccaatgcttcatcgtccaaaagaacggtcaaggtgtggacaggacggatgtaggcgaatttgttggacgcccagttcatgctgacagggaaggtcatagccttcaagacctctggaatgcccgccaaaactgtcttagctggctggcctgcttcgtgtttggtcacataaacatactcttcgcccttgatctcgcggaattcaatgtcagctgtcgtcaagcctttgccacggacaaaaccttcagcagccttggtgaagtttccgtctgcgtctaaggcaatcttcttagcaggacccttgaaatcttctgtaagatcagtctgctggtctgccaaaccacgcacacgaacagccaaacggcgtggcgttgaaaagacatcaatgctgtcaaaagccaagcgattgtctgtcaaaaaggtcgccatgcggtcacgcaactggtgcatggctggggttacgatgtaggcaggaatttcttccaagccaagttcaacaagtaaattctttgtcattattctgcgtcctccttcaacaattctgctcgtgttgcttcatccaaaagtgggaaaccgagttttttccgctctgccacaaaggtcttggcaacgacacgggcaaggttacggatacgggcgatgtagccagcacgctcggttacagatacggctccacgggcatcgagcaggttaaaggtatgggaacatttgagtacatagtcaaaggctgggtgaaccaatccttcttccaaagcccgctcagcttctttttcaaacttagtgaagttttcaaggagcatgtcttggtcggatacttcaaaggagtattttgaatgctcatattctggctggataaagatttcaccgtatttaacaccgtcagcccattcgatatcgtaaacggagtcaacttcttggatataggaagccaaacgctccaaaccgtaggttacctcggctgtaacagggcctgttgccaaaccaccaacctgttggaaataggtaaactgcgtgatttccataccgtccaaccaaacttcccagcccagaccagctgagcctgttgaagggttttcccagttatcctcaacgaaacgaatgtcatgttccaaaggattgatacccaaacgctccaaagattccaagtaaagttcttggatattagatggagatggtttcataaccacttggaattggtggtgctgatacaagcggtttgggttttccccataacgaccatctgctggacgacgtgaaggctctacataagccgcattccaaggctcaggcccgatagcacgcaagaaagtgtatggactcatagtacccgcacctttttctgtatcataagcctgcatgagcaagcacccctgctcattccaaaattgttgtaaggtcaggataatttcctggaaagtaagtttttttgacatatttttccttctttctttaaatctaagtcttttagtttacttttagtactaggcaacaagctgcaggcagtactgaggtacggcaaagcgagttaacgacgtaataaaagataaactaaatgacgatgtttttgcgacgtgagccttcctagccgataccgctaggaaaggcgaactagtacagcgtctagctcagtcgccatagcgatgagcgtgtggcaattcgactgaaaggagactatgccactggcgctgtgaaaagtaagtttctttgacataacagcctctttctatatatattgcaaaatggctagttctccacactcggtatagtttccacaaagacagcctgttctgccttgtccatataggaacaggtcatggcttctagatcgatgacccacttgtaaatccctgcttctgctgtttcttggcagaaggtgagaaaatctgtttgtccagcctgatgattgcgtaagatagtcacaaactggtccagattggcttggtccgaaacaggtatcgtcacttgatagccctgcttttccagagtttgccctgtctgtgagcgataggtaacctggccagactggatatccacaatattttccaccatacccaagtccttaaaataggcaatcagtttgggaaaatcaggccctgtaaactgttcatgcccgtgattgatattttctaaggtgaacattggtctcctttctttataatagctgtctttcaccttgagatgaaaaacaagaaatactcggtcggcagacaaaaagaaccgcattctcttcccctgtcaacagacataggggcgttgagaacgcggttccaccctaatttattacttcatttgtatgattctgattgagtcggacatggtcacgactgggaaagcgccaattatttcaagactggcttggctttcactctcccaagctcgctagacaggcttttgaaacaaccttctttcatgcttagtattgtagcagaaaaatcagcatttgtctagaaagaccactatttatccgaacacaatcccgctgacaaatcctacaaggctattgcaggcctatcgcaatctagtagatatttttctggtactactcccaagaatttttctgcgtgttgactgataaaatctagggcattttccaaatcttctactctatcagaattgaccaactccatgaccaagaaagcattctttgtctcatccgtaatcatggttcgctcaccatcgcgccaattgaaacagcgacaaacggcgcctttatcatccttatagcaaacttcacctggtaaagttggattattggtttcatcaccaatgagatagaattcatccccaccctcagtgaccgttagttggagattgcctacaaatgtatctaaatcttcagcaccacatggaagaccaaaacgtaaactcgccgcattataaatgtccactaatggagaaattgttgtgactggacggtcactagttgaacgtttcaaaagtgcttcgatactagaacgcgcgcctttttttgttttaaatttttgataggcttgacgatatgtacgaatgacctcattctcactaaaggtatcttccgtaagaaatttctgggcaattccgttgctttcttccagtaatttcactaattcatcaggcgattgcgccggcgttttataatctttcaataatagaactccaatttttgcatctggaaatagactccaaaaagatgaatcaacaacaaattgtgacatattctcactccttttatagaaaaatcagcaccctatgaacatcttctaagacctaacgacgttcataaaatgctgttgcatgactacccggtggcagtgtttatttaattaaatttattgtataaaaatgctttaaataagtcaaggactatccaaaatttgaaaaaacacaactaaataactatctatgactaatctttctcgtcaagaaatctccaataaactggattacgaagatgataactaaaatcaaaagagttgctaaaaaggtcacatcattattataccgtaggtagccgtatgatagcgcaacctgtcccaaaccacctgctccgatagctcctgccatggctgtatagccgaccaaggaaaccagggcaaatgtcgtcacacgaatcaagtcaggcagaccctcacgcagatagacaaggacaatatcccagaaagtcgcacctgatgcctgagccgcctcaatgacaccacgatccaattctgataaaaccacttcaacctgacgggcaaagaacggaaagactgaaagagcgagcggcaccaaagccgcctctgtaccaatggtttttccaacaataattttcgtcaaaggagcaatagccgccaacaagataataaaaggaatggcacggaagatagaagccaccttgtccaaaatccaataggcagtcttattggcaataaccccacgtggacctgtcaagaccaagaacaaaccagacaccaagcccataaatccaccaaaagcaaaggaaacaaaggtcatatagagggtcaaattaaaatgtgttaaccaacctgtctgaccatcccagcccaatttataaatatctggaaaattcgtttgaatccattctaacatctagttcgctcctttcaaaatcgtcacttccacacgcgcttccgtcactgcttcaatcgcacggtgcaactgaccaggttcacctgataagatcaccaccatctcaccgactggcgtatggtccaaaatttcaatattgccataaagaatattggcagatacttgatagaatttatacaagtcattcacaattgccgtatccgtatttgaacctgcgtacttgagttgcaccaaaatactgttctcaggcaaattcttaacaatatcctgctggtaaattttcaccaaggcctcatcaattcctgttgctgttttgatgaaatcctgtgtcaattcttcttttggatgagagaagatttctaaaactgaaccttcttcgatcaagcgaccatcctgcataacagccacacggttacaaatatcttttacaatctgcatctcatgagtaatcataacaatggtcaagcccaatttttcattcaattcctgcaaaagtgccaaaatctgcttagttgttttcggatccaaggcagaagttgactcatctgaaatcaagattttagggtcattggccaaggcacgggcaatggcaacacgttgtttttgaccaccagacaactgagctggatagttttcagcacggtcagaaagcccaaccaagtccaacaacttagcaactttttctttcttctcttccttgctcaaacccgaatgcttaagggcaaaggctacgttttcttctgccgtcatttgagccatcagattgaaatgctggaaaatcatgccgatttcacggcgtttgctccgcaattgagctggggtaagtgtgaccttttctccctcgtaaattacatcctcatcgatagtaattttacccgctgtcggcacctgcaataaattaatcactcgaacaagggtagatttccctgctccagaataacctacgataccgtaaatatccccttgattgatatggatggtcacatcctttaccgcttcaatcgtacgttttttctgctggaaagttacatcaatattatctagcttaatcatttccttactcataacttgcaattaactcctctactaattcaacatggctatagtagtcagcgatgctgacattttcatcacctgcatggtcgcgactgttggcatttcctaatccaaatcctgcaatcggcacgcccaaggcatgaaaaactgtatgcatgggtcctgtccccggtgacgtcggcaaaatagcaactccttctggcgtcaactttttagccaactcaatcacattgacaatggcagggtgggacatgtcacttcggtagctcatctctcctagagtgaagacaacctcaactttgtcaaaaccatgtttatccaaatgctggcgaatcttatctaatacatcatgcggctccaatccaggtaccagacggacttccatcttagcagaagcctgagctggtatgatggtcttgacaccttgaccaagatagccagttgacaagccttgaatggtaatcgatggttcaaaatacaaacgcttcagaaactcacgacgatcttctatcaaggttggaagggttagtccataaatatccgtcatagactgactggtagccagtgcaaattcttccaccaaggccaattcacgctcatttggctcttgaacctgatcgtaaatgccttctaccagaatttgcccatctgcagcccgcatggattgaagtgctgataataaataccagcttgccgaatcaatgacaccaccataggaagaatgaatatccaagtcagctgatttgacctgaagatcgaaggtcacaattcccttattcccaccagcaatttctagctgatgtaggctattgcgatgcccctgctcccagacaagcaaatcagcaccaatcaaatgttctttatattttgaaagatacttatccaagtcgacagaggctgactcttctgccccttccataataaaaatcacattgactggtaaatggccattctgtctagcttgatattttttcaaggccgacagacgagctgtgatatggcccttatcatcatctaccccgcgaccatagatatagccatcggaaatggtcaattcgaaggggttgcccttctcccagacctgatcggcatctgcaggtactgtatcataatgattgtagaaaatcaatgttttcgcatctggaaccgaagcctcaaacctagccatgacaaagggtgctgcataactatcatccaaaacaacctctgcaccagcttcttcaaatatatctttcaagtaagtcgccacatccagcaaaccaatctgctgagcaaaaatggatttctttgaaatcaagaccttcaacttttcaaaataggtttgaataatcgcatcattttcaaatgcttgaactttactatctgccatactttctcctcatactcaatgaaaaccaattaaatctactaaccaaaatcaaatattctcccacatttctgactttggttaagagattttttcttatctctataaaaacagatagagggctgaacaattctgcccagtcctcaacctatttacattttaccaaactggctcatccataccgtctgaagtctcttcaataacttttttcacttcatccgtgtggtaggcttcgataattttcttaatcgctgctgcttgctctgatttttcccaatcgctacgagctgcaatcaagttgtaccactgttttgaattttcatctttttgctctttgtaaagggcatttttgtaatccaaaccagcttccaacacaaatgtgttgtttacaactgctgcatcaactgagctaagtgagcttgctgtttggcttgcatccaactcagtgatcttcaagtttttcttgttttcagtaatgtcagcaatagttgccaattctgtaccagatacaccaaccttgatcaaaccagctgcttgaagaaggtagagagcacgactttcgtttgttgggtcgtttggaaccgcaatttctgcaccatctggaatttcttccactttagtgtacttgttttttccatcagctgtacctgagtaaagacggattggtgcgatataagtatccgcaatagcaaccaagtcttcaccattttcttgattccagttattcaagaagttatagtgctggaaggcgttgatgtctacttcgttttcagctactgccttgtttggctgtgagtaatctgtaaattgagtgaactccaatttcacttcatcaccaagaatttcttgaactttatcccaacgggcttgctcagaatcgctcaagctcatcacacctactcgaacagttgttgcagatgaatctgaacttgaagaagagttaccacatgcagcaagtacacctactgataaagcagccgttgccaaactaaacaatttttttaatttcataaaatgatctccttaaattaactgtatctatcttaacacagaattttctttctgactaattgactttttttatagaaagttataacttttcgttataacaaatacccttgcaattataagtattgataataaaaagagggatacccctcttaaaatatatctactaaatactgaaataggtctcgatgttgcttacaatcattgtataaaaattctggatgccattggataccaaacaaagcttggttccctctactttcataagcttctatcgtaccatctctaggatccaaacctgtcgccaccagtcctggagccaattctttgattcgttgctgatggaaggaattaatagggctcccttgggcaaacaattgaccgattcggcttttaggtttcacttgtaaacgatgggatgtcccagcaataccatcttgccaatgatgatccacctcttgttccaagcttccacctagagcaacattcagcaactgcatccctcggcagactgcaaaaatcggttttccctgatgaagggcttcctcaatcaaagccagttcaaattcatcccgttccaagaggtaatcattactatcaatcaagcgtttttgaccgtagagacttggatccacatgctgaccacctgacaagatcaacttgtcaatcatatcgatataatccttggctaagtcaggagttcccataggaataaccattggtacaccaccagcctgacgaacgctgtctgccaattcacgcgctaccgttacatatacgcgaccagattttgttggaaattcttgctcgtttcctgaaattccaatgataacttttcccataaaaagcccctttctttcattttttcaattgtagcatggctacctagccctgtctaatatagaagttttatggcttgataaaaaataactatcagaactacctataaacaattgctcataaacaagagtttgcctttagcagtttcatagataaaatctataccacgcttaagaaaaaactatactggagccagcataaaaaagtcaagcttgataaacaggctttttttcaagcttttatatagaagaaatatcaaaaaagtagctctctttcaatctgttatagtcaaaagttataactccctctaattttttacaattatacaagagtcgttttttctgttaggataggggcatagaaatattttggaggaaaaaccatgactactactattatcggcttcccacgtatcggagaacaccgtgagttaaaatttatcactgaaaaatactttagaaatgaaattccacaagaagagcttttggaagcagctaaagacttacgtgctaagcactggaatattgttaaagaagcaggcattactgaaatcccaagcaacgacttctcacactatgacaatgttttggatgcggcagtactcttcaacatcatacccaaagctgttcaagaccttgaattaacagaccttgaaaaatacttcgctcttgcacgtggttatcaaggagaaaaaggggacgttcgtgctagaccgatgaaaaaatggttcaacaccaactaccactatatcgttccagctattgaaaaagatacagaaatcaaactagccggtcataagattttcgatgaattccaagaagcaaagaacttgggcatcacaactcgtccagttttgattggtccattcacactcttacaattaactgattttgaagaaggtttaactgctactaatttcgctgatagcttagttgcagcctacggacaagtctttgaaaaattagcagagcttggtgctgaaaaaatccagctggacgaacctagcttggtcaaggatttgactgctgaagaaaaagcccttttcctacgtatctaccaaacactcttggcagataagaaaggtttgcaagttctcatccaaacctacttcggtgatgttcgtgatatttacacagaattgaccagcctaccagttgatgccatcggtcttgactttgtagaaggcaaggaaacggctgcacttgttgcaactggtttccctgctgacaagaccctctacgctggtatcgtcaacggtaaaaatatctggcgcaacaactacgaaaagagcctggctgttttggatgctattccagctgaaaatgtcgttataacaacttcttgctcccttcttcatgtacctttcacaacagcaaatgaagaatttgaaccagctatcctcaaccactttgcctttgcagttgaaaaactgagcgaattgcgtgatttggatgccatccgtaacggtcaaggcgaagttgctctcacagctaacaaggaactctttgcccttgagcgtgttggtcgtgatgcagcccttgcagaccgtcttgcaggactgacagacactgactatacacgcctaccagtctttgcagagcgtgaatccattcaacgcgagaagctaaacttaccacttcttccaacaaccactatcggttccttccctcaaaccaaggaagtccgtagcacacgcttggcctttcgcaaaggaaacatctcagaagaagaatacgatgcatttgtcaaaactcaaacagatgagtggattgcatggcaagaagaagttgacttcgacgtacttgtacacggtgaattcgagcgtaacgacatggtagaatacttcggtgaaaacctgtctggctacctcttcagtaaaaacggttgggtacaatcctacggtatgcgtggagttaaaccaccaattatctggggtgatgtaacacgcttgaacccaattactgtcaaatggtctagctatgctcaaagccgtaccaacaaaccagttaaaggtatgttgacaggtcctgtaaccatcctcaactggtcattcccacgcgaagatatttctatcaaagaatcaacccttcaaattgctcttgctatcaaggaagaagttcttgaccttgaagcagcgggtatcaagattatccaaatcgacgaagcagcccttcgtgaaaaactaccactccgtcgtagcgactggtacagcgagtatcttgattgggcaatccctgccttccgtttagtacactcaactgttgcaccagatacacaaattcacacccacatgtgctatagcgaatttactgacatcattcctgccatcgacaatatggatgcggacgttatctcctttgaagccagccgttcaaatcttgttatcctagatgaacttaaggctaagaacttccaaactcaggtaggtcctggtgtctatgacatccactcgccacgtgtccctgccgttgatgaaattgcacacactattcaagccatccttgctaaagtaccgaaagaaaaagtttggattaacccagactgcggactcaagactcgtggcgaatcagaaacaaaagctagtcttatccacttgactcaagcagctaaggcagccagaaaggaactctaatttatgattggtcaaaccccaagtctctcatttgaaatttttcctccaaaaccagcagtaggcaatgaaaagattatccaaactctcgatgagatgcaaggtttggcccctcattttatcagtgttacatgcagcaataacaatttgaacgtagaagagactactgtcaagttggctaaccatgttcgcaatgaattgcatattccaactatcgcacatttgccagctgcttacttgacaaaagaaaaggtccgatccgttcttcattctctcgatgaaattggtgtacatcagattttagcacttcgtggcgatattattgaaggtcttccccctaaagaggactttcagtatgcaactgacttgatttcctttatcaaggaagaagccccacattttgacattattggagcctgttatccagaagtacatccagaatcaccaaattctgtctcagacatcaaaaatttgaaaaagaaagttgatgccggttgctcaaccttggtaactcaactcttcttcgataacgaagcattttataactttcaggagaaatgttctctagcagacatcgaagtgcctattatcgcaggtattatgcctattatcaacaagaatcaggcacttcgactcttgaaaacctgtgagaatatccgcctccctcgtaaattcaaggccatcttggaaaaatacgagcacaatcctgaatctcttcgggcagcaggtctggcctatgctgtagatcaaattgttgacttagtgaccaatgatgtggctggtatccatctctacactatgaacaacgctgaaacagcacgcaccatccatcaggcaactcattcgctattcaaacattatagttagaaaactccccctgagcccaagctcaggggttattctatgccctgtgactcccaaagactacatgataaatttttcaccccatcatgacattaatccagcggatgtctaggtatgagacatcttgcttacaataacgaacagccatttaaaatacagtcacaaggagtaaaaatggcactaagaggagacagagaagcgacgaaatggaaaaataaactccatccgttttcaatttacaatcttcaatacagcattatgctgaataaatcacattgattcccatatattttaatcgtaaataaaaaaactgaccttcaaatgaagatcagttcaaggataataaacagattacaagatggctagaatgatgaaattcagaataaatagagctgtggcaccccaaaggattggatgaatttctttagccttacctgtcgaaacttttaccaagcaatagaagataaaggcggctgcaataccgtaagagatagagaagcaaagcgccatgaagaaggcggcaaagaaggctggaagcgcatcttcaaagtggctccaatcaacatcaaggaaggatgaaaccatcatgacaccgacgataatcaaggctggagctgttgcagcatttggcacaattccaatgaatggtaaaatcaaaattgatagcaagaagagaacggcagttgtaacagctgtcagaccagtacgaccacctgcagagatacctgcagccgattcaacatatgtcgttgtatttgacgtaccaaatagtgcaccgatagaggtaccaatcgcatctgcaaagagcgccttgtccatcttagagttaaagcctgtaccattttcgagagctttttcatcttcttctgagaaaataccagtcttacgacctgtaccgataaaggtaccaagtgtatcaaaggtatctgacaagctgaatgcaaagatagtcatcaaaacaagtggtagacggcttgagtcagcaaagagcgaagatagaccatcaaaagccgctaggaaagttgtaccaagctccgcaaaggctgtaccggtattgttatttgcaaaatcgattgtagacagatccacaacacctgctggaattccagctacagtcgttgcaataataccaatcaaaattgcaccacgcacgttcttaataaccaaaacagctgtcaaaagaagaccgaacactgtcaagagaacacttggatcagtaaaggttgaaataccaggtacgacaccaccaccagcaaaaactgagaaaacaccgtttgagaatgtttctgctgttgcatctgccggagcaacaccatttacagtaataatatctgaaccagatgtcaagaaggtgattaaattagagtttttaaaaccaagataggcaacgaatacaccgataccaccaccgatggcatgttgtaaactaactggaatcgccttgataatactcttacgaacctttgtaactgtgataaaaacgttaaacaaaccgcagaggaaaaccattgccaaagcttcttgccaagtaaaaccaagaccaataaccactgtataggtaaagaaggcattcaaccccatacctggtgccaaggcgtaaggtacgttagcaaataatcccataacaagcgttgatacagcactggcaattattgtagccaagaaaacagcctgtgttggcatacctgccacactcaatacgctcgggttaacgaacaaaatataggacatggcaaagaaagtcgtaagtcctgccataatttccgtagaaacagtcgttccatgttctttcaatttaaaaaattgatccattttttcatctctccttttaatttacgaacaataaaaacattataatcaaaaaacattataatcaaaaaacattataatttcaagttttttaatcttgaaaacgttattttattaattttcaactttaaacattcgtaaattccgaacgttgcaatcttgcaaaaatctatacaaaattacttgcttctttgcttttattatctccttttgttatactggaagttattagttcaagatgtggctacctacaagtactattctttgacgcataaaacaatttctcagcactctaactactacctaaacattattcactattaaaaactagtataacaactctagaaaggaatgctattaaatatgaagaaaaaaatcatagctatcgatttggacggcacattgctcaataatgatagccaattatctgattataccatctcaactataaagaaggtccgccaagcaggacacaccgttcttatcgccacaggtcgcccctatcgaatggctgaaaaattttaccaacaactagaactggatactcccatgattaatttcaacggttctttagttcacatccctggaaagaaatggcaatgggaacaaaatattttaatcgacaaaaaatacctactcgaatttctaaaagaagaagaaacattcgaggcagattttattgctggtgaatacaagaataaattctacatcactcaaaagaacttagacaagattgatcctgctctgatgggagttgaacagattactcctgatacactcatcaaacctgaattaatcactagtgatcctcattccatccttatgcagactcgtgcaactgataagtatgaacttgcaaaagaaatgaatgcctatttcaaagatgaattagaaatcaatacgtggggcggaccattaaatatcctcgaaacttgtgcaaaaggcgtcaataaggcaaccgctctgagctatgttcttaacctctaccaagcctctcctagcgacttaattgccttcggcgatgagcacaacgatgttgagatgctagacctagcaggaacagcctatgccatgaaaaattgtagcgatacacttcgtccgcatgccgacagattgacagcatttgctaattttgaagatggtgtcgcacgtgaactagaaaacctatttttatagacatcaaaaaacctgataaactatcaggtttttgtcatattcgttgcatatttttatcacttttctgaaacacgattatcaaaagtttcggaaatattttgcacttttaacacaaacctacttgacaaatgtactgaaaacgttttataatggtatagttcgaacatgaaagcccattcaatggtttttacatgaacaagaaaaatttaggaggatcaataatgagtattggaatcattattgcaagtcatggcgaatttgctgctggtattcatcagtcaggttcaatgatctttggcgaacaagaaaaagtacaagttgttacttttatgccaagtgaaggtccagatgatttatacgctaagctaaatgctgccgtggacgcattcgatgccgatgatgaagttttggttttggctgacctttggagtggttcaccattcaaccaagcaagccgtgtagctggtgaaaatccagatcgtaagtttgctatcatcaccggtctaaacttgccaatgcttatccaagcttacacagagcgtatgattaacgctgctgctggcgtggaagaagttgcggcaaacattatcaaggaagccaaagatggtatcaaagttcttccagaagaacttcaaccagctgaagctgctcctgttgccgatgctgctcctgttgcactacaaggtgctatccctccaggtactgttatcggtgatggcaagttgaaaatcaacttagcccgtatcgacactcgtctcttgcacggtcaagtggcgactggttggactcctgcttccaaagcagatcgtatcatcgttgcatcagatacagttgccaaagatgaattgcgcaaacaactcatcaaacaagctgcacctggtaacgtaaaagcgaacgttgtcccaatcaagaaattgattgaggtttctaaagaccctcgattcggtaacacacacgccttgattcttttcgaaactcctcaagaagctcttgaagcaattgaaggtggtgttgaaatcaaagaattgaacgttggttctatggctcactcaactggtaaaacaatggttaacaacgtattgtcaatggacaaagatgacgttgcaacctttgaaaaattgcgtgaccttggcgttgaatttgatgtgcgtaaagtaccaaacgattcgaagaaagacttgtttgaacttatcaacaaggcaaacgttcaataaatcgatctgttagtatagaaaggattacaacatgtcagatattacacttatttctgcaattctcgttgtcatcgttgccttcttcgctggtcttgaaggtatccttgacgaattccaattccatcaaccattggtagcttgtacccttatcggtcttgtgactggtaacttggctgcaggtgttatgcttggtggttctctacaaatgattgcacttggttgggcaaacattggtgcagctgttgcacctgacgctgctcttgcttctgtagctgctgcaatcatcatgatcaaaggtggcgacttctcaactgaaggtattgccgttgcaacaacaactgctatccctcttgccgtagctggtcttttccttacaatgatcgttcgtactatctcagtcggtcttgtacacggtgctgacaatgctgctaaagatgcaaacttcgctgctgtagaacgttaccacttgtttgctcttctccttcaaggtttgcgtatcgcagttcctgcggctcttcttcttgcaattcctgcagaagctgttcaagcagttcttgaatctatgccagcttggttgtcaggtggtatggccgttggtggtagtatggttgttgccgtaggttatgctatggttatcaacatgatggcaactcgtgaagtatggccattcttcgcacttggttttgcatttgctgctatcagcaaattgacacttatcgcacttggtgttatcggtggtgcaatcgctcttatctacctcaacttgtcaaaacaaggcggatcaggtaacggtggtgcttcatctaacgacccaatcggcgacatccttgaagactactaagagaagggagattcatcatgtcagaaaaaattcaactttccgtaagcgatcgtaaaaaagtttggtggcgttcaaccttccttcaaggttcatggaactatgagcgtatgcaaaacttaggttgggcttatgcaatgatcccagctatcaaaaaactttacactaaaaaagaagatcaagctgctgctcttgagcgccacttggaattcttcaacacacacccatacgttgcttcaccaatccttggtgtaactcttgcccttgaagaagagcgtgctaatggtgctgaaatcgatgacacagctatccaaggtgtgaaaatcggtatgatgggacctcttgctggtatcggtgacccagtcttctggtttactgttcgtccaatccttggtgctcttggtgcttcacttgcactatctggaaatatcatgggaccaatcatcttcttccttggctggaacatcattcgtatggccttcctatggtatacacaagaatttggttacaaagctggtagcgaaatcactaaagacatgtctggtggtatccttcaagacatcactaaaggtgcttcaatccttggtatgttcatccttgccgttcttgttcaacgttgggtatctattactttcgctgtagatcttcctgctaaacaattgtcagaaggtgcttacatcgtcttcccagaaggtactgttactggtgctgagttgaaaggtattcttggtcaagctcttagcggacttagccttgaaccaactcaagctcaaacattacaaggtcagttggacagcttgattcctggtttgatgggacttctccttactttcctctgcatgcacttgcttaagaagaaagtaacaccaatcacaatgattatcggtctcttcatcgtaggtattcttgctcgtttcttcggaattatgtaatcaaggaccccgctcttgcggggttttatgatataatgaatatctagggagagagcactatggcacaatcacaaaatacaagcgttgaactacaaaccacaggggtttcctacatgggctttggtggcaaggttggtaaatttctaattggtgacaaggcacttgaattctacccagatagcaacgttgaacgctatatccagattccttggtcagaaatgactagcattggcgcaaacgtttctggcaaagcaatcagccgtcattttgaaatttatacagagaaaagtcgattcttgtttgcatctaaagattctggtaagattcttaaaattgcccgtgagcatatcggcaatgaaaaagttgtgaaattaccgactcttatgcaaacaatcggcagaaaaatttcgaatctatttgccaaaaaataaaaattcaagtataatagtagaaacggataagtagcatctggctccttccagaaagtctgcggtcgctgtgagcagataggaaaaagttgtgaaattctaccgttatgaaattatcaaaatacaatcaagtgcacagaatgtgaagctggatggaaccgcggtaaatatcgctccagcatctctcattctgtgcttttttattctaaaggagacatctatgctagatatcaaacgtattcgtactgattttgacggagtggctgccaaattagctactcgtggtgtggctgctgaaaccttggcaaacatcaaggaattggatgcaaaacgccgtgaaatcttggttactgtagaagaattaaaagcagagcgcaacaccgtttctgcggagattgcccaagcaaaacgcaataaggaaaacgctgacgacaagattgctgccatgcagaaactgtctgcggatgtgaaaaacttagacgctcagcttttggaaatcgatgaagaattaaacgccatcatcaccgttcttccaaatacgccgcacgattctgttccagttggtgcggatgaagaagaaaacgtagaggttcgccgttggggaacacctcgtgaattcactttcgagccaaaagctcactgggatttgggcgaagacctagatattctggactgggaacgtggcgcaaaagtaactggtgcacgcttcctcttctacaagaacttgggtgctcgcttagaacgtgccctctacaacttcatgttggacgagcatatcgcagaaggctaccaagaaatcatcacgccttacatggtcaaccacgactctatgtttggtactggtcaatatcctaagttcaaggaagatacttttgagttggcagacactaacttcgtcctcatcccaactgcggaagtgccgttgaccaactactaccgcaacgagattctggaagaaaaagacctgccaatctacttcacagccatgagcccatctttccgttctgaagctggttctgccggtcgtgacacccgtggtcttatccgccttcaccaattccacaaggttgaaatggtcaaatttgccacaccagaacagtcttatgatgaattggaaaaaatgacagcaaacgcagagaatattctccaaaaactaggcttgccttaccgcgttttggccctctgtacaggcgatatgggctactcagctgctaagacctatgacttggaagtctggattcctgcccaaaatgcctaccgtgaaatttcaagctgttccaacacagaagatttccaagctcgtcgcgcccaaatccgctaccgcgatgctgctgacggtaaagtcaaattgctccacaccctcaacggttctggtctagcggttggtcgtacagtggctgccatccttgaaaactatcaaaatgaagacggttctgtcaccattccagaagttctccgtccatacatgggtggggtagaagtgattaaaccttaagccatacaaagaaagagcgaggaaaaatcctactcgctcttttcatttatctaaaaatctactcccaaagtctttaattgttgacgaatcttatcttctagagcccgaatctctagtctatcttgttctagttgctgcgttacttgcccgagatcaatctcttcctcttcctcaaaagtatcgacgtaacgaggaatatttagattgtagtcgttttctacaatttcttctattgatgccaaatgagcatatttgtcaacagactgacgattgtgataggtctctacaattttttctaccatgtcatcggaaaggtgattctgattcttccctttctcaaactccttgctcgcatcgataaagaagacatccttggtctgacgattttttttgaagactagaatagtggttggaatgcctgtgccataaaacaggttagctggcaagccaataactgcatccaggtaatttttctcaataatcagtttgcgaatatgaccttctgctgctcccctaaagagcactccgtgtggtaaaacaatggccatggtccctgtattattcagatgataaagactgtgtaagataaaggcaaagtccgctttagaagctggtgctaacttaccgtattccataaaccgtggatccttcaatttggactcacgattgtcccatttagcagagtagggtgggtttgcaacaaccgcatcaaaactacgtggctgatcgattccaagttcatccaccccgtccggccagtcactttctaaggtatcagcattattcaaaatcatattgctgtagccgacctgatgcatcatcaggttcatccgcgccaagttataagtagttgtgttcatttcttggccatagaatttgatatgctggccctgaggtagttcattacgcactgttagtagcaaagaccctgaacccatggttggatcgtaaacagagaagctagtatctgatttttccaaacctaaagtaacaatcttggctaaaatcttactcacttgatgcggggtataaaattctccaccttttttacctgccgaagcggcaaactgtccaataagatactcatagatttctcccagaatatcctttccttcgtcatttttatactcaatgctatcaatcaacttcacaatactgttcaaggattttgcacgcgcaaccgttgaattgcccaaacgagagtcccctagattgatgtcattaaagacgcctctgaaatcttccatagcatcccgattgagttctacattggcgttaaaatgatcgaaaatcgtctggtagtcactcgctacaatctcactgttatcaattttggctaccagtcttgcccaggtatcttcaggctcgatggcatacccaaggtgagaagctgtattttccaaatgctctaccaagtcattcccaactgcttctcgcgcataggcatcctgaacagtttctcctggagcaggactgataatttcatcttccaccaagaaacgctcttgatgctcagatagatagcgatagaacatgaaggctaggatatagttcttatattccgaagcatccatatttcctcgcaattcattggccatggaccaaatctgattagtaatggcctgaatagtttttgacatgtttttgtaatcctttcatgttgtttcattttttactcgaaatctcattttcgctgatgaagagtaataagctgatctaggtcggaaaagaagctaccgatggcttcttgttcagggagggtggggagggagataggcatgccaagaaaagtttctgtgtggattcttttagcttttctagagccatttgcaatatttccttgataataataaaattctttgcgagatacaaattctaacagaaattgcccgtttatccctttcaataaatcaaaagcaggcgaatcaagagttgattcataaccatcaagttctggtggaataattccaaaagcttgatttaaaaagtctaatttcccatatataaactggcctgattttcttatataatactgtgtagctgaactaccactataaatttctttcttggaaacaactcctctcccccataatcttacagttaacttccttgctatatctcctttactacctaaaattttactttctttcataaactcccccaacttacgctgtttccaagcgtccgtaaattctgggaatcttagctcaggaaaatcgtttccattccctttcggaaacattttctgtaacaaagccttcttcaattctttaacatcatctaattttcgctgatgaagagtaataagctgatctaggtcggagaagaagctgccgatggcttcttgttcagggagggtggggaacactactgtcgtggattttaaattagccttactaattgagctcacttttgtcccctgcattaaaggtaaaatttgattatggtatgcagttgaattaattagataacctaaatagtagggggcataagaaactttcggcctagcaactatcgtatgtaaaccagaaacaacattcttacccttaaaatttcgaacttcaatagctttcccaacagtcgagtcttctgccgcatccgcgaaaacaatatctccttcactaagtaaagcatctgcaaagtctgaaatcgtacttccaataattgatggaagttctttgttacatacatctaaaatagcatcatattttgttaaaatatccccataatgaatgttctgaacttcataaaaatacgatgataacttatctctagaaagtgagtttgtttttatggaaaagtccgccacctcccccaacttacgctgtttccaagcgtccgtgaatccggggaagcgcaatcgtggtacggttgatttttcttttgtcatagtccctccttttctactctctttttgttctatttctgaaagttatttttgcaatttttcggacgatttccattctattatacgctatcatccaacaaaatcgcaacctattgaccaaccaagtcgtcggccaaatcatatagtgcttgtctcaactgattgcggtactgaatcttgctcaagcctttaacagcatcaccttctgcccaggtctggtaatcgcgactagcttcttttatcaaggtacgtaagtgtccggtatcatccaagtcattctgaccatatcgatgtctcgtcaacaactctcgtagttcttggttgcggatatgttccgtcaagccccattggattcggaaagcaaagagcttcttgtcaatgtaaacatgcgaagcttcttggataatcttctgactatcaatccccttgactggataagcaaagttcatatcttgtgtcggaaaatcacctcgatagattgcatcccctgtttgacggatctgatcagcatagttgaggtcttccaaaccgcttgcaaatctatccaattcatccctggtagctgcggcttctaccatcttctcttcgtgaacctgattcagcaagagctcaaccagttcggtcaatttatcgtagtcaattgtcacttccttgatgtgagtcatcttgagttcaatttggtgaatgctaactttttgctctttcgccaaggttcgtttcaattcgttggctaagaccgtcgtcaaaagtttttcttcctctacagacattcccaaactttcaataaagcggtccggctgattgtaatcaaatccttcaatcaccccatcaacctcctctggctgatactgtttgagcttagacagtccttgattgtaagcacggagcaattctaacatagcctcacgctttttctcagacttcggaatatcattgaaatcacccgtcaactctctcaattggtcgaccgtttgtttgacttcagcaaatacttccttgaaaggcttagccaccagtccatttttttcattgttatttttttgttccgcatctgataaattagcagcactatcatctgcatagatggccaaggcctgattcatcaatttctcattatgagctggccagcggtaattgaccacccgtccaaaaggttttttatccatatcctccacacgattggtacgagaataggcctgaataagactggctcctttaagggttcggtcaacataaagagtattgagctcaggagcattgaaacctgtcaataactgatccacgacaatcaccaaatctaagtagttcttgtcctgagctgttctattgaggcgactaatcaggtcctctgtatacgcagcaacatctgacaagccaaaggacgtcccaaattctgtgttatagatcgtaatagcttcaagcaaaccagtatttgactcgaccatgctatcattattttgagtattcaaggcaaaggtcaatcccaccttcaagaccagacctccttgctctcgatgtagttgattgattcgttgaaactctcggaaatacatcatagccatgggtgtggaggccctgcctccacctacgtgggtggtgaacaaggcattgtaacgaccactgccagagcgatttgcccagtgtttgaagacatcttcgactaccaatcgaacatgctctggattttcatcatagacgctagaagtcaccgcatcatccatatcatctggacttagattggcaattttttcttcaatctgtgtacttgtccacttcgggtatttttgccgataaaaatctggtaagtaagttgtttttagtttttcctgatcgatggttgtctcaaaatctaccttaaaccctagtacattgcggtcactaatggcatttttaatagtgtaggcatgaagaagagggccaaaaatatcttgcgtctgcagactagcacctgtatcatctaagttgggagttcctgtatagccaatccaagccgctttcttaaaggccttttgaatccctgcaaaactatctccaccagttgagcgatgagcttcgtcaacgataaacacgatatgcttatctggtgatttgaaggattttctcttcaccagtgtatccaatttttgcacagaagtaacgataatcccactatccttactagtcaactgccgtgccaaggctgtggtattttgagtttctcgaatactgccaaaactattctccccagcttctggatcataagccagataatcatccttagtctgattggtcaatgcgatacgatccactagaaagacaaccttgtctaccttgggcattcgacttgccagccaagctgttttaaaactagtgatcgtcttccctgagcctgtcgtatgccagatgtagccaaccttgttacagcctagttcaaaatcgactttttttatcccctcaatgaccgcatgagtggcgtaaacttgatagggacgcatgactttcagcatttgtttctgcggtgtcccgtctaagatcatgtagttggtcgccatctgatgggccataggaatgctgagcatggaatccgcaaagtctttccaattccgaaccttactaccgtcagatttacgctgccagtggaaagcaaagtccttattaaatttttccgcagtggtattggccatatagcgaacattgttgggggcgatagcgactagaatctgcaaggtagaaaaaatatccgtatattgccgttcctggatatattggtgcatttggttcaatgccttgtccacatctaccgtatcctttttctcttcaatctgaataataggtaagccattaatcaacaaggttgtatcgaatatacattctcgtcgtccagggattttaggagtcctacgaatttggttcaccacttggtagacagtgtccccaccgcctatcttacgttggtcgaatactgtcaaaaatgtatgccgtccatcatcaagcgtaatttccaattcggaaacaccgctaattccatataaaaactggccagcctcataaggtgtcttcagatctgaaataatctgcttgacttgagcaaactcagtatcgctcaagggtttgtccaatcgatgttggttgtgttgccagagaatattacgaaaattttcccataattgctccgttgtcttgatacccggctcataagtccacagtttagatttgactgcatacaaggtcgaagaatcactaacagaccattctaaaccttctaggtgctccggttgtgtaatagtccctgtcgtaatatactgaatcaattctgtttcaaatgctaattcattcatgtgagtaaacctcctttaacaaatatgttagtcgtaaaaaatctccttgcgcataagcttgccgcttctgccgtaaggctaatccatctaaataaatctttcctagtttctgctgactatctaaaggaggcaaggcacctagctgtaaacttttcagttgcttgactgtatatttcattacctcactcccctgtaagctttggtaaaactgccgtctaatagccgaggattcattgatcagatacagtaagaaggccttatccagctttgcaatgggctcaattttgatatagttctgtgtatagagtaagcctgcgtgctccgctctcactaaaacagccttccccgatagtaaactaaagagtaagtctccctcctcgagcaaggtcacttctctatctgtcgtcacggtccgactatctatcacttcttctatcacctcataaccatccaattgatgatgttgctgattgtagaggatatagtctctagcatcttcccagctagtagtatccaagcgaacctgtaaactacctcccataaagagagccaattcttctagtttcataatttccctttctttgaaatttttcataattacattttttgataaactaagtatagcatcttctcagaaacctgtcaataaattatgtaatttacaaaaattaaaaaaggaggttctgccatgaacttatcaaaagaaaaattgcttttccatcactattatgcaaattggcttcggatttacaaggaaggagccattcgagaagtcactctcaagaaatatagaatgacattgcagtggcttatcaggctagctcctagtctgttgttggaagatttgaatcgggttcgttaccaagaattgattaacagctatgctaaaacacatgaacgacagacaaccatggattttcatcaccagttgaaaggagctattttagatgctgtagatgaaggaattattgaacgagatccgacacgtaaggtgattatcaaaggaagacttcctcgaaagaaaaagacaaaatacctcaaccaatttgaacttcatcagttgatacaagaattacgtctcggagaggagctgaattgggattggctcatcttattgattgctaaaacaggtattcgattctccgaagcccttgctctcactactcaagattttgattttcaccgacagctattgaccattgataaaacatggaattataaaggagacggcggatttttacctacaaaaaataaatcttcaattcgaaaaatccaactcgactggcaaaccagcacccaattcgccaacttattacagcacacccaacctgatgacctacttttcgtgaagaaagagcggatttacaactctaccatcaatgccattcttgaaaagcgttgcctaagtgcaaatcttcctgtcgtcaccattcacgccctgcgacacacccatgcatctattttattatttgccggggtctctatcgcaagtgttgctagacgacttggtcatgcaagcataacaacgacccagaaaacctatcttcatatcattcgtgagttggaaaaccaagatgttgatttaattatgcggtcactctccggactttgttaaattccatgtttctacttatagcaaaagacgaatccgtatggaaccgtcttttcttatatatagtaaaaaactgttgcaatgaaattgttcaccaagtgtacgattattggatagattaagtatctactcttgtaatagaggagagacaaaataataccactgccagcatcaatcaaccaagagcctaagtctgttggaccatgaaaggagccaaaaacgaggcttgaaacaactattcctaacaaaacctgtgatccaaataatttcttaaagaagtagcctcgaaatatgacttcttctacaactgctggcaaaaatgctgttgtcaagagtgccagtctaaaaggaactcccttcaaaaattctataatcgaagcatcgttttctgttgtggtaacaccctgcaattccaacaaataataaccaagcatatccgtcaactgcatgatagcaaaggctaatataactatcgccagaccgtcccaagtaagaatgttagggtcccagactggcagatcattttttcagcccgccaccagaaaaagactaaaagtccaagtgtcatcagcccaactattaccaaggtgacttgcgatttggacccttccaaaatcagatccggaaggacagcaagcactaagagaccaaaaatccttaataatagccaaatcttccgaccaagccatttcaaactttgacctagtttctccatactcttctcctcttccgcttcatcatatagagtgccttcaatctattataggatttcacgtaatgtcaatcaaactgttctgttgttgtgatacagttttacaaaaattcaatgaatttgtcaatatacactaaaaaacaaatacccttacgatgtttgttgccatcaccccactgattatttagcgaggtgtgtcatcttcaagtagggctctagtagagaaaagccctgaatcaagcgttccagcagttcctcctcggaggcaacggttctaaacggtacatcatacttgaccaatactttacgaatccgtcctgcttcaacggcttgtaataggctctgtctattctcctccgttccgtccaggcgataaaatacctgtccctcttgcacccaataataaagcggtgccgcaatcgagcagttcagaacacgattttgctgaagcagagaggtctccactttctttcgttcaataaaactgacttctactgaaatccctgcttcagttcccttaccatacaaacgaatagcaagagccgagtccgttagactagcagagggaaaacggtaataggtccaaaaatgtggtctgcaaatttgggcttgattcatccattgactgaccctctcaggcacaaagggactgacgtgctcagctaagactaaacttaatgtctgaaactccttgcgtgctgcctgtgctacattttttaaggctatcatatcgcctgccaaagctcctgctttttcaggcttgcaataatgaactccttgataatccaggtatctgcgacactgttcaagcatctgaatctcctatccacttctccatatagaccatatccatgccttcttgttcaggctctgttttgatggccttgtagccgagcttttcgtagaaagaaactaatttagactcctgcaaaaccgtgcagagaacccagcgtctaactgtcggataaaggctttccaattcgagcatagccttgtgaccatagccttttcctctgtggtctggatcaataccaatcaagcctagccagccctgttcagcgtcttcagcgaccgttgtccgtactagtccgactgtgtgctcttcctcgataatcttgtaatagctacaatttggtcgtgcaaagcgtgattggaaatagtccatagtttcaatggcagggttgtactggtcctgataggttttatataaagccgcaaatgctcggtgctgaataggtagcaattcttctgcgtttgatagatctgcttttactaacatggaaaacctcctgaaattattttatccattgtatcaaatctatcaaaaaaatactaggtcttcctagtattttctaaagcgttgatagcggttttcgagtagttgttcaagtggtaaggcttgtagttgagccaactgactgaccaggttgtccttgatatcagacaagacttccttggtcgctctgccattttccaaaaccaccctatcgaccacttggagtttctccaactcataagaagtgatcttcatgagttctgccgcttccatggctcgactgccgtctttccagaggatagaggcgaaaccttcggggctgaggacggcgtacatggagttttccagcatccagacctggtctgccaccgctagagccagagctccaccagagccgccctctccgatgataatagcgataataggcaccttgaggtcactcatctccatgaggttgcgggcaatggcctcgccctgtccacgctcctcagcaccgacgcctgggtaggctccggcggtattgataaaagtgacaacagggcgaccaaacttttccgcctgcttcataaggcgaagggccttgcggtagccttctgggtggggctgaccgaaattccgtttgaggttgtcctgaaggttcttccctttttggataccgataactgtcaccggctgacctgctagaaagccgatgccacccactacagcttcgtcatcacggaaattgcgatcaccgtgcaattcgataaagtcatcaaagagttgtgtggcatagtccaaggtcgtcaggcgagcttggtcacgtgccaaacggatcatacgtgctacatcactggtcatctgacacctccatgcattctcagcaagcgactgatggtcgctggcaagtcctggcgtttgacaatagcatcgacaaagccgtgttcctgtaaaaattcagccttctggaaatcgtcaggcagattttcccgaacggttgactcaataacccgtcgtcctgcaaaaccaaccaaggtctgcggctcagctaggataatatcgccttccatggcaaaactagctgtcacacctcctgttgtggggtctgtcaagaccgtcaggtaaaagaggccagcattggaatggcgtttcacggctgcagaaatcttggccatttgcatcaggctcatgatgccttcctgcatccgagcaccgccagatgcggtaaagaggacgactggcaaacgctcttcaatcgccaactcaaagaggcgggtaattttctcaccgaccactgtgcccattgaagccatgataaagtgagaatccatgattccaagggcaactggctgaccgccgattgtcgccttgcctgtcaaaacagcttcatccaagcccgttttttgacgggtggctgctaatttctctaaataattggggaagtccagcggattagttgtttcaatccctgtaaacaattcctcaaacgatccttcatcaactgtcaaagcccggcgttcctgggctgtaatccgaaaattataggaacagtgttgacaggttttctctaatcctaaatcattcttgtaaaggatgaccttacaagcaggacatttagaaaagagttcatctggcacctctggctttgcttgaggtgctgactctatccgcgaacgattgggattgatgcggatatatttgtcctttttgcgaaacaaagccatagcattctcctagtttacttttttagatcttcttgatagcggggtaaaaattcttccatgaggtaggcagtgtcataatcaccagccaccactcgcttgtcggaaatcaagtccagctggaagtccgtattggtcaccactccgtcaatttccaattcgtagagggctcgctgcatcttcatcagggcttcaaaacgattttccccatgcacgatgaccttggcaatcatagaatcatagtaaggcggaatggtgtagcctggataaacagctgaatctacacgcaaaccaacgccaccacttggcaggtagagagtggaaatcttacctggacttggggcgaagttgaaggctggattttcagcattgatgcggcattcaatggcatgaccagtaatcttcacatcttcttggcggacactgagttcctgaccagccgcaatcttgatttgctccttgacaatgtccacaccggtgacaaattcggtaacaggatgttccacctgcacccgtgtgttcatttccatgaagtaaaattcgcccttggcttcgtccaaaagaaactcaatggttcctgcattttcatatccaactgactgggcagcccgcactgctgcttgaccgatacgttcccgcatggtctgaccgatagcaattgacggagcttcttctaaaactttttggttattgcgttgaagggaacaatcccgttctcccaaatgaatgacatgaccatgctgatccgccaaaatctgtacttcgatatggcgagctggatagacaacacgctctatatacatagctccgttatcaaaggctgctttggcttcgctggaagccgattcgaaggcaggcactaggtcttcagctttttccaccttacgaatccccttaccgccaccacctgccgatgccttgagcatgacagggtagccaatcttttcagcgatttcaagggcttcttgactggtcaaaacttcaccgtcagagcctggaataacaggcacttgagccttaaccatctccgcccgcgcgttgattttatcgcccatggtatccataaccgtcccagaaggtccgatgaacttgataccaacctcttcacagagggtggcgaatttggagttttcactcaaaaatccaaagccaggatgaatggcctgggcacctgtcacaacagccgccgagatgactgcctgcatattgagataggagtctgtcgaacgggctgggccgatacagacagcctcatctgccaacatggtgtggagagcttccttgtcagcctctgaatagacagccaccgtcgcaatccccaactctctggccgaacgaatgatccgcaccgcaatctcaccacgattagcaatcaaaatcttctcaaacatgatgaatcctatctcctttttaacatagaataattatttatcacaagctcagcccttaactagtttgcaaaataacggaccgattcatactcaatgaaaatcaaaatcaggctagctccaaaggtttgggaaagctttggaggttggagatagagcgaacgaagttcgtttctccaagagcagatatactcctgctactttcttatcttatggtagcaggctgtcaagctccactggagcttgacactcatcaaatcaagtcaacaacggctgagtttgattttcgaagagtattattttccaatagcaaaagtcaacgtccccgacgcagccagttttccttccacctctgcctttgcctcaacgaccgcaatggttccacggcgtttgacaaatttagcggtcatgattaactggtcaccaggtacaacttgcttcttaaatttaaccttgtccataccggcataaaagaccagcttgcccttgttttcttccttggataactccaagacacctgcggtttgtgccaaagcctccatgatgagaacacctggcatgacaggatagtctgggaaatgcccattgaagaagggctcattaatggtcacatttttgagggcaacaatctcatcttccgatacttcaaggacacgatcgaccaagagcataggatagagatgaggaagcgcctctttaattttcaaaatatcaatcatttgatgcgtaccaatccttgtccaaattctacaacatcttggttggccaccaaaatctctgtgaccacaccgtcacggtcagctggtacttcgttcatgaccttcatggcttcgataatcatgagggtctggccttttttaaccgtatccccaactgccacaaaggctggcttgtcaggggctggggacaaataagccacgccgaccaaggggctttccactaccgcaccttctgccacggggctggcacctgcttctgctggagctggctcactcatttcaactgctggcacaggggctgggcttgcaggagttactggggcaagcggagcttctaccgctggactcggagccactgtcgcctgctggtttttactgaaatgcaagatctccccagcattgctatacgaaaattctcgcaaacttgactggtcaaactgactcatcaggtccttaatttctgtaatattcacttaggcctcccaacgtttgaaagcgatgactgaattatgcccaccaaagccaaatgtatttgaaatggcatgacggatttccatatcacgcccctgtccataaatgacatccgcttcaatatcttcagataattctgtcgtaccagctgtctttggtgcataagaatgacgcatagcctcaatgacagctgccgcctcaactgcacccgccgcccccaacaagtgccctgtgaaggacttggtggaagaaactggcgtgttcttgccgaatacggatacaatagcttggctttcccctttttcattagccggtgtcgaagtgccatgggcattgatgtagtcaatatcagctggctctaaacctgcttctgaaatggccaacttcatggccttaatagcacccagaccttctggatgcggagaagtcatgtggtaagcatcgcaagtatttccataaccaacgatttccgccaaaatcgtcgctccacgcgcctctgcgtgttccaaactttccaatactaaaaccgcggaaccctctcccatgacaaaaccattgcggtccttgtcaaatggaatagacgcacgttctggatcctcagtagtcgacatagctgttaaagcttggaaaccaccgattgcaaacggagtaatggctgcctctgctccgccagccagcatcacatcttggaaaccaaacttgatttcacggaaggcttcccctaaagcatcatttgatgaagcgcaggctgtgatgatgcacttgcagacgccatttgcaccgacctgcatagcaatatttccagccgccatatttggcagggcctttggaagagccatgggacgaatgcgttttggacctttttcattcatacgagcaacttgctcttcaatttccaaaataccaccgatacctgttgataagataacaccaaaacggtcactatccactgtctctgtatccagctgtgcattagcaatcgcttctttagctgcatagagtgcatagagcgagtaattatcgtagcgatttgtatcctttttcacgaaatatttgtcaaaaggaaaatcttttaattccgcagcattatggaccgaatattcactggtatcaaacttggtaatctttccgatcccaattttcccagccttcaaactattccagaactcctctggcgtatttccgattggagatgtcagaccgtagcctgttactactacacgatttaattttgtcattttcagtcctttctcattaggaaacttactgcatggtcaagccgccgtcaaccgcaatcacctgtcctgttagatattcttgcttggcaagaaacactgcaacatcagctacttcttctgtcgcaccaaagcgtttcatcggaatttgtgcagtcatagcttctttaatcttgtcagataaaacatctgtcatatcagattggataaagcccggcgcaatcgcattgacacgaacatttcgcccagcaacctcacgggcaatggctttagtaaatccaatcacacctgccttagaagcagaatagttggcctgtccagcatttccaatcaagccagatacacttgatagattgataatagcaccctcacgagcctttgtcattggtttcaaaacagcctgcgtcatattaaaagttccagtaagatttaccttcagaaccgtatcaaaatcctcttctgtcatacgaagagccattccatctttggtaatccctgcattgttgaccaaaatatcgacgctaccgagtgtttcgatggcttctgccaccattcgtttggcatcttgcgcgcttgaaatatctcctgaaatagctaggactttcacaccgtaatctgcaaagctatccagcaagtcctgacctagctgaccacgaccattaagaacgacatttgctcctaaactggcaaatttatgagcaatagccaaaccgattcctcgacttgaacctgttacaaaaacatttttatttgttaattccatgattcctcctcatgatttgtttaatactatttgtagcccctctatatcttcaattgctacaacatgcgccgtcttatcgattttcttgacaaatcctgataagactttacctggaccgatttcaataaagttagtcacaccagcttcctgcatggttgcgattgactcatagaaacgaactggttccatcacttgacggggcaagagggacttgatgtcctcttttttcataacctcggcttccgtattaccgaccaactctacttggaagtccgcaagttccacctgctccaaggcctgagccaattgctccgacgctggtcgcaggagagccgtgtgaaaggggccagatacattgagcggaatcatccgcttgacacctgcttccttcagcaattcaaccgcctcatccactgcagccacctcgcctccgatgacgatttgggctggtgtgttgtagttggctggggaaacaatcccagaggtaacagtcgcacagatttcttcaatcaagttgacatctgtgttgagaacagcaaccatcttaccagtccctgctggcgcagccagttccatatattcaccacgcttagcaatcagggcaatcgcatcttcaaaggccaaagctcccgatgccaccagagctgaatattctcccaaggatagaccagctaccatgtcgggttgtattccctcttcttccagcagtcgaaaaatagccacagaagtggtcaaaatagcaggttgggtatagcgagtctgatgtaatttatcctcttgattgtcaattaggtcgcgaatgtcataccccagaatctgactagcctggtcaaacgtttctctaactatcgggtaatattcgtaaaggtcgcgagccatccccactgtctgagacccttgacctgcaaaaagaaaagctgtctttgtcatcctattctccaaccgaagcccaacggcttgcctcttctctaatcactttggctgctccataatagatatctttcaaaatatcttcacaagattcttctttagaaactagaccagcaatttgaccagccattacggagccatttgttacatcaccatcaacaactgcattgcgaagtgctcccgcaccaagctcttcaatagcatctgccgaaattttacctgccaagaaatctttctctgcagctgcataagcagatgacaacttattcttgatggctctcacaggatgtccaacaatagaagctgatacagttgtatcaatatccttagcttttaaaactttttccttataagcctgatgggcattggactctgtagctactacaaaacgagttccaacttgcaccgcttctgctcccaacataaaggctgccgctgcacctgcaccatctgcaatacctccagcagcaataacaggaatagatacagcttcaacaacctgacgaaccaaggtcatggtggtcaatttaccaatatgacctccggcttccataccttcagcaataacagcatctacccctaatttttccatgcgtttagcaagggctacactcggtacaacaggaataactgtaatccctgcagcatggagacgctccatatacttccctggatttcctgctcctgtggtgacaactttcacaccttcttcgatgaccaagtcaacaatgtcatccgcaaaaggagacaaaagcatgatattgacaccgaaaggtttgtccgtgatagatttaaccttgtcaatatttgccttgaccacctctttgggagcatttcctccaccgatgattcctagaccacctgcattagatacggcaccagccaaatctccatcagctacccaagccataccaccttgaaaaattggatacttaatatcgagcaattctgttattttcgtcttcataattccctcatctttttttcttgcttacctaatcatttgaatatcaaatcattaggtaaacaagtgaagggttgccccccctcactcaaaaaatagtttgatatttcaatgttttgattatcaaagtatttaacttaagaaaaatgctacatagcactctccttaacagtcattattttgttttttcttcaacataagcaaccaaatcgcctacagtagtcaaaccttcttcagtgtcgatttggatgtcgaatgcatcttcgatttcagagataacttggaaaagatccaatgaatctgcgtccaaatcctcaaaggttgttgtaagagttacttcttcagcatccttacccaattcttcaacgatgatttcctgtactttttcaaatactgccatgatatgtgtctccttttgtaaaataaaatattttaatcttgcctagggcaaggaattaactaaagttgtaagagtagagttccccatgtgaggcctccaccgaaaccagccatgagaatagtctggcttccatccaatcgcaacattccgctctctacacattctgataagagaataggaagacttgctgcactggtattgccatatttatccatatttgctggaaatttttcacgcgccactcccaatttacgagccatcttatccaggatacgtatattggcttggtggagcaagaaataatcaacgcaatccacagtcatatcagcttgttctagcagctctgccatggttgccgtaacatccctcgtagcaaattcaaatatagctctgccctccatttggataaagggttgctgacagctttgtgtcgagaatggcgtctctttctggtctatccctgctgtcagactagcacctcgaccgccatccgttcgcaagatttctgctaaaaaggtcggttgttcacacgcttccagcaaaactcctccagcaccatctccaaataaaacagccgttgatcgatccgaccagtcgacagacctagatagggtctctgcaccaatgacaagtcctctcttatagactcctgaagcaagcaatttttccgctgttgatagcgcaaaaacaaatcctgaacaagctgcaacgagatcataggcgaaagcgtttttcgcgccaattgctgcttgaaccatagctgctgtagatggcattgaagcatctggagtaatcgttgctacgatgatgaagtcaatttcactagcatctagctgagacttttccagtaattttctagccacttgactagccaaatcactcgtcgtctctccagtaacaatgtgccgttgaccgatacctgtacggctacgaatccactcatcactggtctccattcgttgagccaaatcatcattggtcacaatcttcttcggaagatagtgggccacctgactgattttagcatggtttctcatttcaaatcctccaagaagtgatagagtttcatgagtcctttcttcattacctgatactctgcatcatccataccatctgtaatctgtttcaccatttcattgtgaaatcgttgatgcaaacgatagaccagtcgaccttttttggtcagatagagatgaacaactcgccgatctttggtcgaacgaatacgctcaacatatccttttctttccaaattgttcaagctagttgtaacagtacctaaggttaccatcaaagtccgagcaacatcactcggagtagctccatcaatacttcctatcacatcaatcgtgtgcatttccttaatcgaaatatcattgaatcggctaccacgcagacttgtttcttcaatcaccaacacattgttaaaaatggccgttagatattcatttacttttggatcttccaaaacaggcctcctttactttgatagtcaaagtataaaccataaaactttgattgtcaaacattttttactaatttaaaaattaatctcccgtaaacactggtctacgtcgttctgcatgcgctcgaactccctctttaaaatcctctttataggctaatgtttcttgtaaatccagctccaatcggcgataagactcccagtctttaaattgactttcccatgtcaattgtttgattgctgcataagaatttactgagcctcgcaagagtttttttatgacctgggcaaccgtcttttctagtttttctggctctgccaatttataaataatcccatattctaaagccttatccgctgataagccctctccagtcatcgccaagtgactagcacgattagccccaatagcacgactcagtagaaagagcccccccgcatccggcgcaagtccaacgcctacaaaggcttggatgaattttgtcttgctggaggcaataacaaaatcagctgccactgccatattagccgcggctccagccactgccccatctgtcaccataatgactactttagacaatttcttcatcgcaaacgaaatatcattcaccagctctgctatttttaccaaagaagcaatatcatcatcatcaactgcacgcttcatctcaactaaatctccacccacggagaaaatggaaccctgtgcttgaatttgtaaaattttgacggaggcatccccttctgcaaggcggattgcttctaagatttcttcacacataggaatattaaaaccatttgccacttccggtctgtttaaagttagaatcgctacggaatcaattacttcataacgaattgtttgataggccattctcttgctcctttcaaaatagtttgataattaaaagatttgaatatcaaacttcaatttcttgttttccattgtaacatagtttttaaaattgtcacttttttctagcaaggaaagtgtgacgtccgaaaaagatggaggccatcatcgcaatataaaatttagatatgctagaaaataacgtgtctaagaatctatattcacacgcaaagcgccttggctttttcactcatcaaggtagttttgcgggaaatactgactgtattttgaaaaaacaacctcaatatgcaagtctgaactgtaaattataggctctaagtttaatttacaactttcattttttcacgttaatacttttggaagatttaactggattctgagctagaaataccatttttcacgagaactgatgcttggactacaatataatatttcttaaaatcgcaataagtcaaaggcatcttcaagattgtctaccaatttgtctgctttcgactgatcaattccataatgctggtctcgaatagcccaaactgtcaaacctgcttttttagccgcttcaatccccttcgcactatcttcaaatactaaaatgtccgatttagctactcctgttgcactagctgctttcatataaactgtgggatctggctttggggcctcacaatccatcgctgagaaaacatgactaaagtgaaagcgtataccagcatctagtagagcacgttcgatttctgaacggtcggtatttgaagccaaaactacaggaataccttggatagttagtctctccaataccgctttaacttcaggaaaaatcctctctgcataaggggttggtcgcttttctttatacacacgatattcttcttccaaggcagggacatcccagttatcataatcatcccctaaaatccgttgccaaatttgactagctcttccgccgacaaatatagatggatccaaatgatcaaccgataaaccttttgtcgctaaaaaatccgctcgacgttgaaaatagaatgtttctgtatcaaaaagtacaccatccatgtcgaaaataattgcttttaccatactcgcctcctattactttaattgtaacacagttgaaagaaaaaaatgtttttctgaaattttcatacttgtctcttgttcgtttttcgataaaattcttggcaagatttgtctgaacatactgacaatttcatatcattctgctataatagaaaaaaatatccaaggagatgagaatgaaagttattaaatttgggggaagctcacttgcttcagctggacagttagaaaaagttttcaatattgttcaatctgattcagaacgtcgctttgttgtggtgtctgcacctggaaaacgcaatgccgaggatactaaagttactgatgcgttgattaaatattataaagaatatgttaacggaaaagatgtgactgccagtcaagaatggatcatcaaccgttatcaagcaatggttgacgaacttggtttcacagctaacagcatgaagaaaatcgcagacagcatcatctctttggccagcctaccaattgatgataacgaattcctttacgacgcattcttagcagctggtgaagataataatgccaaattgattgccgaatattttacccacagaggattgcctgcacgctatgtccatcctaaaaaagctggtattattgtcagctccgaaccaggaaatgctcgcattttgccttcaagttatgacaaaatcgaagagcttcgtgatacagatgaagtactcattatcccaggatttttcggtgtaactgttgataaccagatttgtaccttctcacgaggtggatcggacattacaggttccatcattgctgccggggtcaaggctgacctctatgaaaactttacagatgtcgatggtatttttgcagcccatcctggcatcattaaaaatccacattcaatcaaagaattgacctatcgtgaaatgcgagaattagcttatgcaggtttctccgtcctccacgatgaagccctccttcctgcctatcgcggacgaattccattggttatcaaaaacaccaataacccaactcaccctggtacccgaattgtacacaaacataccgagcaaacagttcctgttgtcggtattgctgcagacgatggttttgtcagcattaacttgtccaaatacttgatgaaccgtgaagttggttttggtcgcaaggtattgcaaattctcgaagatctcaatattcgctgggagcacatgccgaccggtattgacgatttatccatcgtagtccgtgagcgtgaattgactcctatcaaggaagaagagatccttcgtcaactcaatacgaaaatggaagttgacaaggccgaaatcgaacatggtttatctattatcatgattgttggtgaaaatatgaagagccatgtcggtgtaacagctaccgctaccactgccctctctaaacaaaacgtcaacttggcaatgatttcacagggagccagtgaagtttctgttatgttcgttgtcaaaaccgaagaaaagaaacgcgccctgcacgcactctatgaagctttttttaacgagcaataatcacaacgaggtcgcttcatactcttcgaaaatcaaaaccagacgttgttgacttgatttgatgagtgtcaagctccattggagctagtctgattttaattttcattgagtaccaattaaaatttgaataaacaaaaatagcttagaatcaacgtttctgacgatgcaattctaagctattttttattttttatactcaatgaaaatcaaaagtagcctaggaaacgaagtcgaagatagaactggagttcatcaaggcaagttgacaacggataattttgattttcgaagagtattggactttttgaccagcctcattatagtcttttagtttacttttagtactcgctccaactatctgggagatagttggagactggggacaaagggagtgggaaagaactcgaccaagataaaaagagttcgtcttcccaccccccgcacagttgattaggccagatttggagtgcaaaacacgaacaaatatgccaatcaaccactgcgctgagatgttgacacgaactctgagtagtggtcctggactttttgcccagcctcatcaaaagccacaggcataactcaatgctttcttatttctaggtgaccagctgatgtacttcgcttttttgttttcaggctcaggtacgaatagtccactggactattcgtatcccccagattgcttgcacagtcaatggactgtgcaaggtgggagataatacttgcaaagcaagtcacttttacaaaatcaggcaaggcgagttcaaacaatccggtggagtgtttgaagttggaaatatggaaacgatatttcctcgattgtcaaagtaataaaaggcaactaaatgacgatatttgtattatagacaatctctaggcaacacttctctaatattttagccttctattttagtgaaagaagcggattatcatcacgtttactcaaaaattcgaggtagacgatctgtcaaaagacaaaccacctcgtaatttatggttccgatgcgatcagcccactcctgaacagagatcgttttatctccatcttgaccgattagggtgactttttgaccaagtggataagcacgaggtaaacgaatggtgatctggtccatcgaaatacgccctacaatttcacaggcctgcccatcgactaggactgataagccttgtaagcttcgtacgagaccatctgcatatcctatcggaacggtcgcaatccattctgaatcggtgctgtgataagtagctccatagccaattgttgtgccagcttcaacctgctttacatgaacaatttcagatacgagagataaggctggttgaacaccaaacgggagttctagtactcgtccacttggattaagtccataaagaatgtttcccaaacgaaccaggttaaatactgtatcagcatgccaaatgcttgttgctgaattgctggcatgaatccagcgcggagtaattggtagaacatccaaaaattctttaaaaacagacagttgactctcgaagtgcgcctgttcaacctcatccgcagtagcaaaatgagtatagactccttcgatgtcatactctaattcttcaaggatagcaatcgcttgtagcaaatcggctatttttctaaaaccaatccgccccatacctgtatccagcttaagatggacagttagaccagataaatcagcctctaagtcttttgcatcttgcaaccagtccagactggcaactgtcacactgatattgagttgatgagctactggtaaaaaacgtacaggaaccactcctaaaatcaagataggatgctcgatacccgctttacgtaactctaatgcttcatccaaattcgaaacacaaaaaccagctgcttgactggataactttttcgctaccgcaacagctccatgaccataagcattcgccttaacaacagcaaatgcttcagtcttagggggcaagttggtcattacttgctcgaaattttccgcaatcgcatctaagttaacccgaatttgcgtgggtcgatgttcactttcaatcatctttctcctccaaaatcacactagcttgtacaaaatttcctgaatggctaatgctgagccaaatattcccatcaaagggactcttcgtcacatagggaactcctttgctggtattcagaatttcaatatcatgaaatcctatcttaccaatgcctgtccccaaggccttggtcagtgcttctttggctgaccaacgtccagctaaatattctagctgacggcgaccggacagactttgataccgttcaaattctttctctgtgagaatctttttgggaaacccttggtgtttgattctggcactttcaatcgcctccatctcctgaaggtcaatgccatgtcctactatcattaatcggtctccttttgcatagtcacttcatttattaaaataaacgaactgactctagtgacttgtctaaaaattgcaaaaggactggacagccgtccagtccacgcgtcattcctatttacggccgtgacaatttttaaatttcttaccagactggcatgggcatggatcgttacgatcaacaccttcaaaagatacattctcctgaattgcatgcgattggttcggcataatattcttaacagctgtcgtatgtgcttcttgacttgtacgctcacgctcaatattgtcatgaatttgcgccttcatcatcaagcgggttacttcaaactcgatagccccaatcatatcgttgaacatagtaaatgcttctgattgatattcaacgattggattgttttgagcgtatccacgaagactgactgcattgcgcaattgatccaaggcatcaatatggtctgtccatttgttatccacaacacgaaggataagaactttctggaattcgcgtacacgttcttcatcgcgtaattttttcacttgcgaatcatagactctcaaagcacgttcatagagctcttcgacaatctctttctgattcattgcttcaaaagtagctttactcaaggtatcatcttcaacgagatttgcatgcgcaaatttgataataccatcaatagcttcatctttcgaaccaaggaagtgacccgcaacttggcgttcaatcgtccgtttcatcatcgctttgatttcaggagccaaatcacggtcagcagtaataacatcctggcgttggcgatagatgatttcacgttgctcacgcatcacatcgtcatattgaaggacttgtttacgtgagtcgtagttgttcccttccacacgcttctgagcagattcaacttgacgtgtcaacattttagacttgataacggactcttcttctgttagattcatacgctccataaatactttgatgcgttctgaaccaaagcgtttcatcaagtcatcttcgagagatagatagaattgtgattcacctgggtccccttgacgacctgaacgtccacgaagctggttatcaatacgacgactttcatggcgctcagtaccaataacacacaacccaccaagttcacgtacacctggacctaacttaatatcggtaccgcgtcccgccatgttggtcgcaatagtgaccgcaccacgctgaccagcattcataataatctgtgcttcacgatagtggtttttagcattcaatacttcgtgagggacacctgcagctaccaatttttgagaaatcaaatcagaagtttcaaccgcaactgtaccgaccaagacaggttgccctttctcatagcgtctcttcacatcagcaataacggcattaaatttgtattctagacttggatagagtaaatcttcgtggtcaacacgcgcgattggacggttggttggaattggtacaacacggatgttgtagatttcacggaattcttcctcttctgttttaccagtacccgtcatccccgataactttttatacatacggaaaaggttttggtaggtaatagaggcacttgtcttagactcgttttgaaccggtacaccttccttagcttcgatggcttggtgaagtccatcagaataacgacgaccttccatcgtacgacctgtaaatggatcgataatcatgacctcttggtcttcattgaccagatagtcaatatcataggtcatgatgtagttggcacgaagtgcattatccaagaaatgggtaatggctacattttcaatatcgtagaggttatctaacttgaagaatttctctgctttgtcaatacctgaatcagacagtccaatcgttttagatggaatgtcaatgatgtaatcttctgttgtcaaagatttaacaagattatctgccaagaaatacaactggtttgtttccgaaccttgtgcaccagatacaatcaacggcgtacgagcttcatcaatcaagattgagtcaacttcatcgaccaaggcataattgagaggacgttgaaccatgtcttctgcgcgaacaaccatattgtctcggagatagtcaaaaccaatctctgagttggtcgaataagtaatatcgcagttataggcctcacgtttttccaagggtgatttagcagctaagttgataccaactgatagaccaagccatgaatacaattcacccatttcagtcgcatcacgggtagaaagatactcgttaaccgtcactacgtgaacaccttgaccagacaaggcattcaaataaacaggcatcgttgcagtcagagttttaccttcacctgtacgcatttctggaacgtcaccgttgtgaagaacgattcctcccataacctgaaccttgtagggatagagacccaagacacgtcgagctccttcacggactaccgcataagcttcgtacaaaagatcgtcgagggattcaccgttattgtagcgctccttaaattctgctgtcttagcttgcaactgttcatcagtcagcgcttccatttcatcggcatacgagaagaccttgtctgccattttctcaagttttcttagctctcccttatcattttcaatgagagaacgaagtacatttgttaccatacatttcatcctatttcagttttagtcaataatatattgtagcagaaaactaggcaattttcaaggtttggcactaggatacagcctaaataaatgaaaatgctagcttaatattactatttttaccacaaaacacctcctagtcacaataactcctaggaggtgaaaaatttataaaattttaaatgaggaatctgcgatatatcggagatttagaaattcattaaaagctcagttatcatattattcagttaataaaagctcacatgaataattttctacacaaagataaacgtcatctttaacctgtgttaatatattattttcctcgagaaaaatatctcatgaagaaactagtagataaagctacccaaattgttactaagctgttaagtacattttccgaagtaaggatctcttttttctctggctctcgattctcaattgttgcatttgaatcgaccactttttcttcctcaacagaattgttactacgttcaagagaggtaggcactttcaccttgccagctactgcacttctctcttgagaagaagttgcaacacctacaggctcaactgttgaaattgcttcttcaaacaatgtcgcagataaagagtaaggttgaggcaccgtgtctgaaccagcatcttgaacacgaatatctgatgtcggaacagaaactgcctcatgagtatttgcttcaactccatttggcgtagttgcatctgctttctcgtctaaatgttcatttttaggaacctctaaagtaagtgaagcagaacttgtttgtggagcagaaaccagtgggtcagctacttcttgtttagctaccaccacctctgtagaattagcttccggtgaagttggggatgctgaactactcgcaactacacttggttctgttacttctgttgccacttctgctggagctgtttctgatgaagttgggatttcagaaattacttgtggagctgaaaccggtgagtcagctacttcttgtttagctaccaccacctctgtagaagctgtttccggtgaagttgggatttcagaacttacttgtggagcagaaaccggtgcttcagctacttcttgactagttgttaccgtctctgtaggagttgtttccggtgaaggttgagatgctgaactactctcttccgatacttctgttgccacttctgctggagctgtttctgatgaagttgggatttcagaacttacttgtggaacagaaaccgaaggttcagccatttcttgactagttgttactgcctctgcagaattagtttccggtgaagttggggatgctgaattactctcaactacacttggttccggtgtttctgttacctcctctgtaggagttgtttccaatgaagtttgaggtgctggattactctcaagtgcacttaattccggtgcttctgttgccacctctgtaggagctgtttctgataaagtttggatttcagaacttacttgtggagcagaaaccggtgctttagctacttcttgactagttgttaccacctcggcagaattagtttccggtgaagtttgagatgctgaaattacttgtggggcagaaacccgtgattcagctttttcttgactagctgttaccgtatctgtagaaatagtttctgatgaagttggggatgcagaacttacttgtggagaggaaactgtattaacctgcgcttcactcgattctttggatgaaggctcaacatatggtaatttagcatcactttcttccttagaatcaactgtattctgagctgtttctgaactcggtgaaaccatctctgtatttcctaaagatgaagtctctgttttatcctctaactcagttttagcttgtagtgccttaggagctgctggtgtttgttgagaaggagcagctgagattgtttcctgtgttgaaggagttccttcaagctcctcagattgctgtgcagaattaacacttggagccgaagcatccttggaattttggctgacttcatcagaattagcttggttttcttgcaattcatttcggtttctatcatcatcagaatttgtgttatttttctgacgattctttagataactttgataagtttctccttccgaaaattcttttccagccttcgcattcatttgccccaagaacactcgagctaaatccattgaattttcgagtgctttaaattcttcttctgtaatcttggagagagcactcaatttatcaatatcagaattgacaaattgtaaaacacgatcatacccctcttgtttatcatctttatcgtctttatccgttgctttcgtttcttctactttacgtttcaaagctttatagatatctagcaaatgatttttcttattttctgttatataagttggctcaacatatgcaatataatccaaaccaaccaaggacttttctttgttgaacaacagtaaatctgctgttttttgtttcatagcccaactctcataattactatcaataatcatgtagttacgctccgccttaggctcctgtcctgcctcaacaacatcataactatcctcaccaatagtagaaaagtgtttctcgctatatttagctgagcgctgatgcttattccctgtaataaaacctgtaccgtcaatggtgtgccactttttatcataataaacacgcgctgtagcatgcgggacaccttctgcatttttcccaacaacaacataagcaggaagccctaacatattaaatgcacgggccgcagtagtgctgaaacctacacacatcgctttctgacgttcagtaaccgcgaacaaatctgatcctaagtagtaattgatgtctgcataattttgaacagccttattagcagcttcccaatcatatgttgtatgattggcaacatactgaacaaatgccttaactttatcgcgttcacttgattgcttcatagcttctgaggactctatcaacttatgaatcaagtcatcatttgctataaaacgctctttggtaacgtttatatttttaactgaattatgagtatatttactataatcctcatagtacttattatcaactgtaagaccatgcgagtaaatagtcattccattaatatttttcaaactattctcagcagttcctagacccgcagcatttaataactgccgtttattggagtcaagctcaatcttaaatagtgcatgaatccgttttggctccatactattatgtaagtcgccatttcccgaaaacctcaactctctcatctgattatgataatcttcctcattatgagcaataacatcacccttgttcataacaaggatatgtggaaagtcatgaatattttgagtaactttaccattgattaccaaaaaattgttgtttttaccaaattcttccaattcttcccgagttgataatgttcccagtcgattttcaaatcctaatttcaaaacatgaaattgtcgttggtccgaggagtagtctttcaattttttagaaaatgcttcccagttcagaacctctattttattggtgttttttggcgattgtaaatgtgagttttcatctgcaaaaacaaccggttgtgatgttccgatagatgcaagcgcaagaaccgaagtagaaagggtaagtgtcaaaataagccagcgcttaccatgctgttgaattggaatcataagtcctccatataagtacttctgagaataatttcccagcctaaaatttgcatcccaattgtaacacttttaactatcttttttctgctatctatctgtgcttttcctgtttttatagactttagtgtctccgcatcatcactttagatatagcgttttcatacaattgggaaacaacaactttcctctggttaaaaaatatcactacactatcgccaataaaaagattttcaaccttgcttatgaataatcatcaaaagttgtggaactcgtttctctttttcatacccgatgaactccaacaatggcaaactctaatcttttatagtcatcgttagtttttgaggcgctgtttcggctcaaaaacttaaattgaagagttgttgacgaactcttttaagctggtcgagttctttcctactccccaaaactgccttgattaacgaatggctatctcttatgaatacagttttttagataaaaagaagtgagagttacataaaaactctcacttcactgtcaagttattgtgataataaaacaacttcacccaatattcttcaatatatctatcgccaaagtacaaatgaatctgttctcatagacaattatgaatttcttgacacctgttttgccaaagcaaagttcccaagagttgcagaaccattttcagcaacagctggcgttacgatatattctttgacatctggtgttgggagataatcgttcatcaaaccgacaaacttctcacgtacacgattaagcatgtgctcttgagccataactcctccaccaaatacaattacttgcggacgataaagcaaggttgcctgtactgctgcttgagcaatgtagtaagcctgcacatcccaaacgtctgaattgagctcgatcaattcaccacgaatacctgtacgaccttcaagagaaggacctgcaactaagccttccaaacacccattgtggaatggacacattcctttaaattcatgttttacatcgtaagggtgtagggcaacgtaagtatgacccgcttcggcatgacccaagccaccgataaactcaccattctgaatagcacctgcaccaatacctgtaccgattgtatagtaaaccaagctctttacccctttacgaaccagggtttcaccaaaagctgatgaattcacatctgtcgtgaagtagaatggaatgttaaattccttagcaatcagaccaagtaaatcaatatttgaccagtgtggttttggtgtcgaagtgatgtaaccataagtctgtgagttttgatcaatatcaattggaccgaaagaacctatcgcaatacctgccaaacgatcttcatagcgcttgaagaattcaactgttctctcaatcgtttcataaggagttgtcgttggaaattgcgttttttcaacaacttgaaagttctcatcacctactgcacaaacaaactttgtaccaccagcttctaagctaccatataattttgtcatttgattgtctccaaaatttttatcacttttattataacatataagcaaacagaagaaaaaggctgaaagcctttttcctgttaattatgtagtagagtcatgctctacaaatcgattttatataagattacttagctactttcaagaattctacaccgtgagcgattgttccctctgcaagtggagatacttctgcaaagtcagcagtgttggtcacgatgatcatggttgtatcatcaagacctgcttcagcaatcttagctgcatcaaatttagcaagcggagtaccagcttttactttatcacctgctgctactaatttttcaaatccattaccattcattgatacagtatcaataccgatgtgaattaaaagttcagcaccagacgctgttttcaatccgtaagcatggcctgtttcaaaagcaattgttacttctgcatctgctggagcgtaaacaacaccctcagatggtttaacagccaaacctttacccatagctcctgatgagaagactgggtcattaacattttcaagggcaacaacatcacctgaaagtggagatacaagagtttcttcgttgagctcaacagctggagttgcaggtgttgctactggagctgccgctgctttaggtgcagcttctacttcatcttcaaaaccgaagaggtaagtcaatgcaaaaccaagagcaaatgatacagctaccataaggatgtattggaacaattgaccattaccaacataaagtgtcgcaccaggaatgatggttacacccatacctttaccagcaagaccaagaagagatgctacagcaccaccgatggcaccagcaatcaatgaaagaagaaatggtttgcggaaacgcaagttcacaccgaagatagctggctcagtaataccgaggaaggcagaaagagctgctgggaaagcaagagctttcaatttaggatttttagttttcacaccaaccgctactgtagcagcaccttgtgctgtcatagctgcagtgatgatagcgttgaatgggttagcaccagtgtttgctaccaattgagcttccaagaagttgaagatatggtgaacacctgatacaacgataacttggtgaacaccaccgataaggagaccaccaagccccattggcaagttcaagatagcttgtgtaccagctaagatgtagttttcaaccacgtggaagactggaccgatgacaaacaaaccaagaatagacatgacaaacaaagtcacgaatggtgttactaagaggtcaagaacttctggaacaaccttgcggactgctttttcaaatttagcaccaaccaaaccgatgatgaaggctggcaatactgaaccttgcaaaccaacaactgggatgaaaccgaagaaaatggttggcttcacatcaccacctgaagcaacgacccaagcatttggcaattgaccagcaatcagcatcataccaagtacgataccgatagtttggttcccaccgaatacgcggaaggttgaccataccaccaaggctggcaagacgatgaaggctgtatcagtcaagatttgtgagtaaacgttcaaatcttctggaagagtatagccgagagctccaagaagaccacgaagacccatgaaaagaccagttgctacgatagcaggaatgattggaacgaatacatcaccgaaagtacggatagcacgttggaatgcattgccttgtttagcagcttcagctttttgttcaccagtagtcgctgttggcaaaccaagggcaaccacttcatcgtagattttgtttactgtaccagtaccaaagatgatttggtattgaccagagttgaagaaagcaccttgtactttttcgatgtcttcgactgtatccttgtcgatttttccttcatcaacaaccattacacggaggcgagtcgcacagtgagcaacactgcgtacgttctcacgtccaccaagggcgtcaatgactttttttgcaatttctgtattattcatcttgcaaaaatctccttattaaatattttttgttttttgaaagtgttttcaaactttcgatggttttattatatcacttttataaaatatgtcaaacgtttatcacattttgtttcaattttatcaaaaaacattgttaaaacttgatttttcgcaagaaaacgtttactatattaatgaaaaactagaaaatttggagaaaattatggcatttacaacaggggagcgttacagagcttatgctgactggacacccgaatacattgaaaaaataaagaagaatacagagagttctccttggaggacaaatttccatattgaaacaccacatggactgttaaatgatccaaatggattttcttattttaatggaaagtggactcttttttaccaatacttcccattcggtgctgcgcacggattgaaatcgtgggtccatacagaatcaacagatttggtccattttgaagaaactggtacggttatgtacccagatacaccacttgatagccatggtgcctactctggatctgccatggaatttggcgacaagctcttcctcttctacactggaaatgtccgcgatgaaaattgggttcgccatccataccaaatcggtgccttgatggataaagatggtaagattgaaaagattgataaagtcttgattgagcaaccagaagataccaccgaccatttccgtgatccacaaattttcaactataaagggcaatattacgctattgtcggtggacaaaatctggataaaaagggaattgtcaaactttataaagctgaaaataacgactacctcaactggtcctatgttggtgaccttgattttgccaatgatatgaccgcttatatgatggaatgcccaaatattgcgttcgtcggtgagcaacccatccttctctattgtccacaaggtttggacaaagaggtattggactatggcaatatctatccaaatatgtacaagattggtcagagtttcgttcctgaaacagcaagcattgtcgaaccgagcgaattgatcaatctggactatggttttgagtgctatgcaacccaggcctttaatgcaccagacggtcgaactctatctgttagctggttggcacttccagatgtggaatacccaaccgatgcttatgactaccaaggctgtctgtcattggttaaagaattaaccatcaaggacggtaagctctaccaatatccagtcgatgcgattaccagtcttcgtaaagaagctcagccattttcagcccaaaaagaaaccaataatgtttacgaattggaacttgatttttcagcgagcacgaagcacgaaatcgtattgttcgcaaatgaagcagaaaaaggcttggtcttgtctgtagacactgaacaaggccagattacattggaccgtggcaactgtggtcagccattcgcactcgatttcggcacaagtcgctcttgcgagatttctccaggagctcttacagccaatatcttcatcgacaaatctgtctttgaaatctttatcaataaaggagagaaagtattttctggtcgtgtcttccctgatgcggatcagtctggtatagtcattacgactggtaatccgaccggaacctactaccatttagattatggtcgcaaaactaactgatgtcgcacagttagctggggtcagcccaacaactgtctcgcgcgttatcaataaaaaaggatacctatctgaaaaaaccattcgcaatgtcgaagaggctatgcgtgaactaggctacaaacctaataatttagctcgtagtttgcaaggtaaatctgcaaaattagttggtctcatcttcccaacaataaacaatattttttattctgaattgattagccatttagaaaaagagctttttgatcgaggctataaaaccattatttgcaatagccagcacgagtccgataaggaacgtgagtatctagaaatgttagcagctaaccaagtagatgggattatctcgggcagtcacaatctcggtatccaagactacgaccgtgtcgtagctccaattatcgcttttgaccgcaacctatctccttccattcccattgtctcttccgataattttgctggcggggtattagctgcccaaaccttacaaaaagcgggatgtcacaatccattaatgattacggggaacgatgattccaattcacctaccggccttcgccaagtaggttttacatctattttgaacaaagccgaagtttttcatatctccagtgatttctcacctgtgcgtaaggagatggaaatccgagccattcttgaaaagcaaaaaccagatggtatctttgtatctggcgatgcaacggctatgctggtatggaacgtcattcgttcaatgaaactgtctattccagaagatattaaattgattggttatgatggaaccagtttcatcgaaaactactaccctcaactgacaactatcaagcaaccattaaccgaaatagctcgcctgctggttgaactattagttgataaaatcgaaggaaaaaaactgacaaaaacagactatatcctgccgattagcctactagcaggagctagtatataaaaaaagctgtacctaataaaaattaggtgcagcttttttgtgatacattctcttatttctcaagtaaaaaagaagctcatcaggcttcttctttaataaactggctcaaaactccattgacaaacttagctgaagattcatcagaaaattctttagccaattcaatagcctcgttaacagcaacgcggtctggcgtttcttcgaaatgtaagatttcaaataggcctagtcgcatgatattcttgtcaatcaaggttaaacggtctaaggtccatcctgcttttaatcggctagataactccttatccaagtcatcacgatagtctgctacaccattgacaaggttaaggagaaagagcggaatttcaactccttcttgctcttcttctctatcataaagataagaaaactgagctgcctgaacaggttcttgaccaaattcaagtgatacgattgcctgcaaagcacacttacgcagggcatgtctattattcttcatcaaggaaatcctctccgaataaatctttcaatgctggttttggtgttttatcaggaacaatgccgctgacatggatattaaccgcagccacttgaacttctgcatagttataaactgctgtcttgactgcacgttggatgtccattgatacggcaggaacatttacaccatattctagatagacgtaaatatccgcagtcactcgaccttcctcgtcagtttcaagataaacacctttatttaacgatgtttttgaccaactgtctgctacacgcttattttgaagggaatgcactccatcaactttcgctgcagcaatgcctgtaattacttcaaggacgcgaggtgcgataacaatctcgccttgatattctgttgtcataggctctcctttcttaagaggaaacgattaagcacgtgatacgtaagttccttcagctgtgttgataacgagtttttgacctgcttcgataaagtctggtacgttgactacaagacctgtttccatcgtagctggtttacctgaacctgtaacagtcgcacctttgatagatggttgtgtttctgcaacgaccaattcaacagttgttggtacagtaacaccgatcacttctgttccgtagaactggatcttcacttcagaattctccaagatgtagagcaattcttctttgatagtcgctactggaatttcatactgatcgtaagtctcagtattcataaaataagctgtgtcatccatttggtaaaggtactgtgctggaactgtttcgataatagcttgttcaaatttttcatctggacggtaagttgtatcgaaggttgaacctgtacgtacatcacgcaatttcatacgcatgatggtgttacctttacctggtttgtggtggctcgcatccaaaactttaatcaatttaccttcagcttcgaaggtcatacctgctctaagtttacttgcttcaatcattgtattgaatacctcttcaaattttatttattcgttttattctaccacaaactgtcaaatttctcaaatgacaatcaattccttgggagctaatgtcaagacttcacaaccgttttccgtaatcaataggtcatcttcgatacggacaccatatttgtcatccaaatagataccaggctcatccgtcaaaaccataccggccttgatagtctcgtcagattttccaaaatacggatattcatgaatatccaagccaataccgtgaccgatgccgtgtgtaaagttggctccgtaacccgccgcactgataatctcacgaggaatagcgtcaaactcgcggtaggtgacaccttccttggcctgctcaatcaaagccttattggcacgcaagaccacatcgtaaatctcacgctcttgatctgtcacatgaccgatatggatggtccgtgtcatatcgctgacataatgctggtaatagcaaccaaaatccagcgtcaaggtctcaccagattggataaccttttcagacgctcttccatgaggcatagcagagcggtagccagatgccacgatgaactcaaatgatgccccttctgcaccgagttgacgcatgcggtggtcaaggaaatgattgacgtccatctcagtcgtctgacctggtttgataaagtcaagaacatcaataaaagcctgatccgaaatttgacatgcacggcgaatggtcgcaatttctttctcatccttaatcatgcgcaagtcttcgataaagtttgacatagcaaccagttgataaccctcaaaaatgctggtcagactttgatagaaaccataggtcacctcgctatcaaaaccaattttttcaagcccatcttccttaatcacctttgcaatttcttcaagggcaaaacggctctcgataatatcaaaaccttttactgatgccttggctatcaaggtataacgcgaatcagtcacaaacaagcgacgcttgccactaatgaagacagtcgcctctgtcccccaaaaacctgtcaggtagtaaatattgttttgaccagttaccaagattccatcaacagttgattgagctaattttgcttcaaatttttcaagtcttttttgcatcctattcctccaatgattttttaactattatagcagaaatacagacaaataccaattcttcctagcagatagagaaaaaaagccgcagaggcgactttttatttcaacttcattttcagatactggcctgtaaagctggctgggttctccgccacttcttctggtgttcctgtcgcgacaacggtaccgccaccgacaccgccttccggtcccatgtcgataatgtggtcggctgtcttgataacatccagattgtgctcgatgaccagcacggtattgccatcatcaacaaagcgagccaagaccttgagcaactgggcaatgtcctccgtatgcagacctgtcgtcggctcatccaagatatacaaggatttaccagttgaccgcttgtggagttcagaagccaacttcatacgctgggcttccccacctgatagggtcgttgctggctgacctagagtaacgtagcccaaacctacatcttgaatagtacgaagtttccgctcaatttttggaatatgcttgaagaactcgaccgcgtcattgaccgtcatatcaaggacctgagcgatatttttctccttgtagtgtacttccaaggtttcagaattatagcggtgtccatgacagacttcacaaggtacaaagacatcgggcaggaagtgcatttcaatcttgataatcccatcaccagaacaagcctcacaccgtccacctttgacgttaaaggagaaacggcccttcttgtagccacgaatcttggcttcattggtctgggcaaacaaatcccgaatatcgtcaaagacacctgtgtaggtagctgggttagaacgtggtgtccgtccaatcgggctttggtcaatatcaatcaggcggtccaagtgttcaattcctgaaatagacttgaacttacctggcttgtccgaattgcgattgagtttctgagcaatagcttttttcagaatggaattgaccagagttgacttacctgagccagacacccctgtcaccgctacaaattttccgagtgggaaacgaacagtcacatcttgcaggttgttttccttggcaccggtcacctctaagaatcgaccatttccaacacgacgttccaaaggaactggaatttcacgtttgccagacaggtactggcctgtaatggatttcttgtttttagctacttgggctggtgtgccagaggccacgatttctccgccaaacacacccgcacctggaccgatgtcaatcaaccagtccgcctcacgcatagtgtcctcatcatgctccaccacaatcaatgtattgcccaaatcacgcattttcttaagactagcaatcagacggtcattgtcccgctggtgcagaccaatcgacggctcatccagaatatagaggacaccagacaggttagagccaatctgagtcgccagacgaatccgctggctctcaccaccagaaagggtacctgctgctcgtgaaagagtcagatagttgagaccaacgttatttaggaaggacaggcgatccttgatttccttgacaatgggtgttgcaatggtggcttcattttcagacaaggtcagatgttcaatgacttgcaaatgatccgccacggacaagtctgataattgtccgatatgaagtccctgctcgcctccgactttgacagacagggcttggtcattgaggcgatagccgtggcaggtcccacaggtcagttcattcatgtaagtcttcatgactgtccgtgtgtaatcactattggtttcacgatagcggcgattaatgttggtaatcaagccctcgaatggaatgtcaatatctcggactccaccgaactcattttcataatggaaatggaattctttcccgtcagaaccgttgaaaatcaggttcttctcctcttccgtcaattcctcaaaaggcttgtccatgtccacaccaaagtgattcatggcctgctccaacatctgaggatagtagttggatgagattggattccaaggagccaaggcaccttcacgcaaggtcttgctggcatctgggacaatcaaatccgtatccacttccagcttcacgcccaaaccgtcacagtcgctacaagacccaaaaggagcattgaaagagaagaggcgaggctccaactctggtaccgtaaaaccacaaactgggcaggcatagtactcagagaaaagcatttccttctcatccatggtgtcgatgatgacatagccgtccgcaatccgcagggccgcctcaatggagtcaaaaagccgcgagcgaatgccatctttgatcacaatccgatcgaccacaacttcaatattatgagccttgctcttggacaattctggtacttccgacacatcatagacaccgccattgacacgtacccgaacatagccgtccttctggattttctcaaaaatggtcttgtgttgcccctttttcttacgaacaatcggagctagaatctgcaaacgttggcgttctggcaattccaagacctcatcaacgatttgttccaccgaagaagccgcaatcgctccgtggccattgatacagtaaggtaccccaacccgagcataaagcaagcggagatagtcattgatttccgtcgctgtaccgactgtcgaacgcggattccgcgatgtggttttttggtcaatggaaatagcagggctgagaccctctatggaatccacatcaggcttgtccatgttgcccaagaactgacgagcataggcagacaaagactccacatagcgacgttgaccctcggcatacaaggtatcgaaagccaaactcgacttaccagaccccgacaaaccagtcaccaccaccagcttctcacgcggaatggtcacatcaatatttttcaaattatgggcacgcgccccatgaatcacaatattttcttgcataacatgatataagtgcgttaagaaagcgataagaaaataggaaaatgtgacgtcacatcagtgacaaaacattttgtctttttctcgacgcttttagcacgcattcgaatcctttctaagatataaagagcatcaaatgcacagtcaaaataggcggtaagtccgaattctgtgatttcgaagatgcacccccttcaagacaactagtgctttcacaggttgaaaaccgaagaaagtacagatgtctacgacgcagaaaccagttcccatacttatccatgaagaaactagcactttttgacaccgcatttagcccgtgttcaattcctttcttaagaggctataagctatggtatacggaacaaggaaaagtccgtacaacttattcgcttaaatgtctacatattatatcacatttctatataaaacctttccgaaactgcacattttttggtataatagaggttgcgttaacgcaacaaagataaaaggagggcaaagatatgaaacaaatttttctatcaaccatgactgatttagaagaaatccaaacctttgaaccaggggcttggattaatttggtcaacccctcccagagcgagtctatggaagtggctgagcactataaaattgacatcgctgacctgcgagcaccgctcgatgcggaagaatcctctcgtatcaccgtcgaagatgactatacgctcatcctggtcgacgtcccaattcttgaagaacggaacaacaagacatattatattactattcctttgggaattattctaacagatgatgcaattatcacgacttgtttggaaccattgccactgtttgagcagtttatccatcgtcgtctacggaatttcttcactttcatgaagtctcgtttcgttttccaaattctctaccgaaatgctcaactctacttgtcagccctacggaccattgacagaaagagcgaagagattgagaagcaactccatgaagccactcgaaatgaagaattaattgtactcatggaattagaaaaaaccatcgtctacttcaaggcttccctcaaaaccaatgagcgtttggtcaaaaaacttgctagttcctcacgcctactccgtaagtatgaagaggatgaggatttgcttgaagataccttggtcgaaacccaacaggccattgagatggcagacatctatggttccatcctgaactctatgacccatgcctttgcttctatcatttctaacaaccagaataccatcatgaaaaccttggcattagtgacaatcgttctctctatcccaaccatggtcttctctgcatacggtatgaactttaaggacaacatcattccttttaacgatattccctatgctttttggtggattatcctcttcgcatttgcaatcagcctatcactcaccttctacttcatccgtaagagatggttttaaactaaggagattaacatgtcatttacagaaatcaacggattaacaaaaaagaaccaagaatttatccatattgcgaccaaccaactgattaaagatggaaagtctgatagcgaaatcaaagaactcttggaagaaattttaccaactatcattgaaaagcaaaaaactggtgtgactgcccgcaatctctatggagcaccaagtgagtgggctgctagtaagacaatttctgaacaggaaaagaaagaccaagtggaatacaatgaaaatccatggttgatgtggctagattctagtcttttcatgcttgcaattattgctggtatcaatggtttgatgaatctttttggtcaaggtgcacagtatgggctattaaccttatttgtcatcggtttcggtgttggtgcagggatgtacttgatgtaccatttcgtttacagagaacaaattaaaactgggcaacgtcctaaattgctgaaagctatcgcttttctcggacttgctacgctggcttggtcagtcgttttcattctggcagcactgattccggccgcatttaacccggttcttcctccgcttgttactattcttatcggagctgctgctttcggtgcacgctacctcttgaaaaagaaatataacattcgcaatgccatgtccccagttcaataataaaacaaagcgattggaatattccagtcgcttttgtttatctatacagttcagctatcaaatcgcccgagaaccttatccgctgtcacttgtctatgtaatctgctgaaacagtctatccccagactgtgcctcgctttctaacttcttggctcgggttgaaacagtccattcaaaggcttaattcgctttcttaatttcgagttcatgaaaaaatggtccactctcgccgttgcgcctttccagtttcttgggcgcaagaaaaaatggtccactggaccatttttttaatcttcgtttacgaatggtaaaagagccataacgcgagcacgtttgatagctgttgttactttacgttggtttttagctgaagttccagttacacggcgtggaaggatttttccacgttcagaaatgaaacggctaagaagctcagtatctttgtaatcaacatattcaattttgttagctgcgatatagtcaacttttttacggcgtttgaaaccgccacgacgttgttgagccatgtgtgttctcctttatattattaatttttgacctagaatggtaggtcatcgtctgatatatccattggattacttgctccaaatggactttcttctcgagcgaagtttggtgtagattgtgcaggcgcttgataaggcgagttatagtcatttcctccagcaaacgagttgccagctgaatagcctccaccttgaccttcacgggcagtacggctttccaagagttggaaactttctgcaactacctcagtaacgtagacacgttgcccttgctgattgtcatagctacgagtctgaatacgacctgtaacaccaatcagagcacctttcttagcccaattcgccaaattctcagcttgttgacgccaaatgactacgttgataaagtccgcttcacgctcaccgttttgatttttaaaattgcggttaaccgccaaagtaaaagtcgcaacagcttgattagacggagtataacgaagttctgcatcacgggtcatacgaccaaccaatactacattattaatcatacaacaccttcttacgcgtcaagtttgacaatcatgtgacgaagaatgtcgccgttgatttttgacaaacggtcaaactctttaagagcttcatcgttgttagcttcaacgttaacgatgtggtacaaaccttcgcggaaatctttgatttcgtatgcaaggcgacgtttttcccatgcttttgattcaacgatagttgcaccgttgtcagtcaagatagagtcaaagcgtgctaccaaagcgtttttagcttcttcttcaatgtttggacgaataatataaagaatttcgtatttagccattgatatgttcctccttttggtctaatgactcatggtctagccacgagtaagtgagggatactcacagaaaataattataccataatatagaaaatgtgcaagtgaaaacaattttccgaaaacattttcacaaaaaagtaaattcccaaagtaagttctagtctgtcttaaaaactggaaattagactgagacaaagaaataaggtagaacttactatgggacaagttggtaactgacaatgaaaaacaaacacttaactctctctgatcgcaatgatattcaaataggaattgaacaacttaagcccttctcagctatagcagctaagttaggaaaagatccgtccacaatttcaaaagaagttcggagaaatagggtgataaaagagaactctagtacctccaattgtgaggcctgccctctactcaaaaagactccttacgtttgtaatgcctgtccgaaaaagagaagcaactgcggataccagaaacagttctactacgcaaaaagagctcagcttgattatgaagttaagctctcagattcgagaacaggtgttgcactaaacaaggaagaattctatcgcatggatgagattgtttctgctgccatccaaaagggacaacacctcaaccacatcatcgcctcaaacgaaatgtcggcatccagagcttctatctaccgataccttgaaaaaggctatctgtccacaaagcccattgatttcccccgtgtcgtgaaattcagaaagcggagaatcagaaacctacaacccattcctaaaatcgccaaagaaggacggtcttacgaggacttccaacgctttctcacagagaaaggaatcagctattggctggaaatggacaccgttactggacggatcggcggaaaggtacttctcacctttaacctctccttctgtaactttatcttcgctcaattacttgataataaaacagctaatgaggtcgctaaacatctctacgctatcaagaatgacctgcatcagaaagagatggacttttgcgaaatatttcctgtcattctgaccgataatggcggtgaattcgctagagtggacgatatcgaaatggatgttcgcggagaatctaagctattcttctgtgaccccaatcgttctgaccagaaggggagaattgagaagaatcacacacttatcagagatattcttcctaaaagaagttcttttgacaacttgacacaggaggacatcaacctggtttgttcgcatatcaacagcgtcaaacgagcttctttcaacggaaaatcagcctatgaactctttacatttacctacggtgaggaattggcaacacttttgggaatctctaaaattgacctgagaacgtcattcaatcacctcgattattggataagtaatcgctagtttttatcaaaaaataatttcaaaatagaaaggaacttgttccatccaaaattccagatagctagaacttactttgagacgtctcagagccagtaactttagtgtactcttttttcaacattttcaaccctaaaactcactattatcaacatttttagtcaaaaatagaacttagtctgagactaaattctgttgatgttatgcagttttctcagagtaacttctggaaggacgggaactagaacttactttgagaatttaccattttcacaaaaaataaagactgcccaaacaaagggcagccctatgaattaagctacaatcgcttttgcgacttcttctgttgtcatacgcgagaaataatgagtagtatcaatctcttgaagtttagcaagtacatccgcatattcataacgtgtaccaactagtaagtcttcaacatcagctacatccccaataccgaagaagtcaccgtaaatcttgatggattcgatgacagatttttcagccttgatataggttgtgattttaccagccgggtaacgaacgctgcgctccacagtgtattctggtgtttgaccgtaggtccaatcccatgttgcaaactgcgaatcacggatttcttggattcgagccaaatcatcctcagtcaacacatattcatccatttctggatattcttgcttcatttggttgaggatggcatccttgaactccagaacggtcatcttatctggcaactcgttgttaatgttggtcacacgggcacgaacggatttaacacctttggactcgattttgtctttgctgaccttgagggcacttgcgaggactgacatatccacatcaaagagcaagcaaccgtggtgcatcatgcgacctttggcataggcttgggcgttaccacagattttctttccgtcgatttccaggtcattacgaccggtgaaattggcctctacacccagtgttgcaagggtatcaatcacaggtttggagaaggttttgaagtcaaaggctccctcgtctgccttatttgaaataatagtatagttgaggttatttaggtcgtgataaactgcgccaccacctgacagacggcgaacaacatggatgcccttttcgtctgtgaattccttgttgatttcttcaatagcattctggtgcttaccgataatgatggcaggctcattgatccagagaataaaaatttcgtcaatatctgttaattccttgaaggcataggcttcgagggcaatgttataagctgggtcattgctgttatttacaatgtatttcatgcaaaactcctttattgttaactaatttttattatagtggaaacgataacaaaagacaagtattgaaactcttcttgtccattcttgaattttctcaaaaatgatggtaggctataaaaggaggttttcatgagcaaacacttaaaatcatttttgatcttttatctagccgcaagcatctttcttccttttatgtggtttatcaatgcgccacttatctgctttgtacttcctctttatctgacctggaaaaacatccgccatttttgggaccttttgaaaaaacagttaaaagagtatagtttttggattaacgatggtttgattttctttttaggaacagggctaagttggttggctcttgaaatggctcaagttgtttacgtcgattggccagaaaccttggttaataaccagatccacagcccaatgcagaccgaagcctggtcagggcagtttttcctactccttttgggtgttttagcttatttggtgctaaacatcttccaaactaagctcctcccccctctcctaacggtcctcctcatcagctgcctatatccaagttttgtctttgctgttttgtggactatacaactttctagtttgattgaaacagatttcttcacctactgctacctgtgtttggttcctttcaatatttgtctcatttacagtcggacaattttacaaaccattcaactgtggcaagcagaattagccaagcagagcaacccacgctttcctagactttctgctctcctgcaaaaaagcctttctctgccaatttggctcctcttcttcagtcttccctatcttgcagttcttggctcctatctcattctctttggtcaaaaacctgaccagctacttcagatgtggacggaaaccagtgattgggccttgtcggaaaaaatctccccaccaaacgcattctatgatgaacactatctttgtacagtgggggctgctggtcaccgtaaactggtcaaacccattcgtatgggggaacgccatggacatcgtgtggtggtcaatcgtcagctacaaattgccaatgcttttgaacaaattttagaagaaagatgtccacgcctgcatcgttgcgttcgttccaactacgaccggtatggctatcccatttccaaacatattcgcaaagcttggcaggcggatctgatctatctgatcatgaaaccagccgaatggctcttcctcatcgtcatctatctgcacgatcgtcagccagaaaatcgcattgctgttcagtatttgccgctatcaaaaaatctattaccacaagaaaatactagcaattagtaatatatcacaaaaaagaaagccacatggactttctttttgcttagcttattatttgcgttttggtgggttgtggattgcaacaccaagaacatcaagaaaggcttcatacataacctctgagaaggttgggtgaccgtggattgatgctgccacatcatcaacagtcaattcagattccatgatagttgctgcttcgttgatcatttcagctgcaactggaccgatgatgtgaaccccaaggatttcatggtatttcttatcagcgataacttttacgaaaccatgggcttcgttagaagcaatagcacgaccgttaccagtgaagctattgcgaccgataaggatgttttctttaccgtatttctcgatagcttggtcttctgtcaaaccaaccatagcgatttctgggtgtgtgtaaaccgctgctggtgtgaagtctaatttagccttgtggtggttaccatggatggcattttcagctgccacttcacccatacggtaagcagcgtgagccaacatcttagtaccgttgacatcacctggtgcgtagatacctgggattgatgtttcttggtattcgttaaccttgatacgaccgcggtctagttcaaggttaagattttcaagaccagccaattgtggtacacgaccgattgaaagaagggctttttcagaaacgatttctgagccgtcattcaacttgattgtcaattggttgttggcttcgacgatttcagatacaccaacagatgtcaagaatttcatacctttcttagaaaggactttttgcaattcaacagacacttcgcggtccatacctggaatgatacggtcagccatttcaacaacggttacttctgtgccgtatgatgcgtaaaccaaaccaagttctacaccgactacgccaccacccataacagtaagtgacttaggaatttcacgcaagtcaaggatatcatcagaagtcaataccaacttagaatcaatacctgggatattgatgcgtgatactttagaacctgttgcaaggatgatgctacgacctttgatgaccttgtcgccgatgacaacagtcttgtcaggattcacttgaccaagaccgttgaagattgttaccttgttagctttcaagagaccttgaacgccaccagtcaatgtcttcacaaccttgttcttgaagtcaactgtcttgtccatatcaacggtatagtttgttgaagcaaggttgataccacgctcagccgcaatcttcaagccgtcaaggatttcagcgtttttgaggtaagtcttagttgggatacaacccttgttcaagcaggtaccgccaaattctgatttctcaacgatagcgattttaccgcccaattgagcaccgcggatagcagcgtagtaaccagcaggaccaccaccgacaacaaccatgtcatactcgtctgctgccaattcagccttaggagcttgtggagctgctgcaggtgttgcaggaacttccaaaccagctgctttcaagtcagcagttgcttgagcaacctcagctggagctagtgcagcacccacttcaactgattcgccttctgcaccaaggtaggcaatgacttctgttacaggaactgttgcaccgttgccatgaacgattttcaaaagaacacctgattcttccgcttccaattccatacttgtcttatctgacatcatctccaagataacatcgccttcgttgacaaaatcgccctcttgttttttccactcgatgatttcgccttcttgcatatctacaccaagtttcggcataataatttcaattgccatagttaagataccaagagcgaagagaaagcgactgaaaaataggaaatcgtagaaaatcctgattttctaaacgatttatcttttttccgagctttccgctcgggttcaattgctaaaactctctcgctcttattccctttctttattttttctctttaccaaattgagcacaggctaaaaacctattgaaaaagataaatcgcctcgtgcctcaaagcacatcgttgatttcctattttcatacgtttttcttaacgccttttgcatcttatctcagatcaacaattccaatgggttttccagcaagttcttcaagtcaaccatgaacttagcaccattcataccatcaatgatacggtggtcgatggttaagcagagtgccatgattggacggatcttgatttcgccgtcaataacaactggtgtttgaacagttgatgctacaccaaggattgctgagtttggttggttgatgattgggttaaaggttttagtaccaaacatacccaaattggtgatagagaaggtcgaacctgacatttcagcccccttcaacttaccagattgagccttcttgatgacatctttcgaagccaccacaaagtcagacaagctcatcttatctgcgccgtgaacaactggaaccaccaagccatcatctagacccactgcgataccaaggttgacgaacttgtgtaattcgatttcttgtgcatcgttaatcaaagatgcgttcatgtaacggtgttcttctttcatcaaagtacgaacaaccgcaagaccgatcaagtctgtaaaggttactttcaaaccagtcttgttcatgattggctcaaggacttgcttacgaagtgccatgaggttggtcatgtcaatatcgtagttaagtgtaaatgtcggagcagtcaagtaagagttgaccataccttttgaaatcgccttacgcattgggctcatcttgatgatttcaacgccttctggcaattctttagctggtttttcttctgcttttggtactggagcagcagtttctacagctacaggagcaagtactgcaagaacgtcgttcttgacaatcttaccgttgacacctgaacctgtaagggttgacaagtcaacaccttggtctgctgcaatacgggctgcaagcggagttgcttttggagctgctcccttgaagtcttcgacgtcaaccttgtggacacgaccgttagcacctgttcctggaacaagacccaagtcgattccaagctcacgcgccaatttacgcgcagctggcgttgcacgcaccttgccactaccttgtggtttggcagcagttgcaggagcaacgattactggtgtacgacccgcaggtacttcttcaatagccgctgctggttcaacagcaggagcagatgaagcgccggcttcaaccgtttcaccttcagcaccgatgtaggcaataacttctgttacaggaacggtagcaccgtttccgtgaacaattttcaataggacgcctgactcttctgcttccagctccatgctggtcttgtcagacatcatttccaagatgacgtcgccttcgttgacaaaatcgccctcttgttttttccactcgatgatttcaccttcttgcatgtccacaccgagcttaggcataatgatttcaatagccattattaagataccaagtccgaacagaaaacgaatgaaaaataggaaatcgtagaaaatcctgattttcgtaacgatttatcttttttccgagttttccggacgggttcaattcctttctttcagtttcttaccttgtcaagaaccaaaccagacttcgataatcgaagcggctcaattcttttccaagcattcttagtcatgctagaacattttatttctagcatattagggttatcgtctttccgattgcttttctgacaaggcgatttggtgcaggcataacttacgttaggcaagccaaatcaacacagccagaaaagataagtggatgacgataaaattaacccttgtttacttgcttatagattgccgctttgattttctctacgtttggcaatactgcgttttcaagaatgtttgcgtaaggaactggtacatcgtctgaagcgatacggatgattggtgcatccaagtagtcaaaggcttcgctttctgtgatgattgatgcgatttcaccgatgaaaccacctgttttgtaagcatcgttaaccaagataaccttaccagttttcttcacagattcgatgatcaattctttatccaatgggataagggtacgtgggtcaaccacttctacgctgataccttcagcagccacttcttcagccgctttcaaggcacgttccaacatacgaccgtatgaaataatggttacatcagtaccttcacgtttgatttcacccttaccaagtggaatgtagaaatctggatccaagttcacttcttcttttttaccgtaaagagcttttggctccaagaagataactgggttgttgtcaaggatagatgatttcagaagaccttttgcatcgttagcagtaccaggtgcaaccaccttgatacctggaatgtgagtcaaccaagcttcaagagactgtgagtgctgtgctgctgaaccgatacctgaacctgaagccacacggaaagttacaggtgttttcaaaccaccaccaaacatgtagttggttttggcagcctggttaacaattgcatcaagggcaattgtgatgaagtccatgaaagtcaagtcaacgattggacgaagacctgtttgagctgcaccaaccgcagaaccagcgattgcagcctcagagataggcgtgtcgcgaacgcgttttggaccaaactcgtccaacataccaacagatgtaccaaagtcaccgccgtagataccgacgtcttcacccatcaagaatactttttcatccttacgcatttcttcgctttgagccaagttaatcgcttcacgcaaggccattacttttgtttcagccattttttactcctaatttatatcaatttatctatactgaactaaggaaaaccaaacaattactacgatgtaattgtttattgtcccagcttaagacaccttagaattgtactcgaacttgagtaggtagtccaccctagtttgacttgctatttagagcttagtcaaacttcttacgtttgtagttaggttctgactagaggcttggaaaaatagatgagccattagtgatgtccacatcactagctgactctctaatttttctgtgcctctttaacgtcctcacaccctagtctacaaacacatcctcataagctactgagatgtctggatctgggctttcttgtgcgaatttcacagatgcttctacttgttctgcgacttgtgcttcgatggcatccaattcttcgtctgtcgcaatcttgttttctgtcaagtatttgcggtatttcttaagtgggtcttttgctttccactcattgacttcttctttagtacggtaaacacctgcatcggcagttgagtgaccaaaccagcggtatgattcaacttcgaccatggctggacctttacctgcacgaacgtactcgatgacttcttgcattttttcataaacagcaataacgtcgttaccatcctcaacataatgacctggaataccgtatgcagcagcacgttggtagaggtgaggaatcttagtagaataagaaatgtcagttgaaataccgtaacggttgtttgtaatgaagaagataactggcaagttccaaacagctgccaagttcattgattcgtggaaggaaccttcgttagtagccgaatcacctgagaaggcaataacaatgttatctgtaccgaggtattgttgcgtaagggccgcacccaccgcaagggcataaccaccacctacgataccgtttgaaccaaagtttcctttttcaacgttagccaagtgcatcgaaccaccacgacctttagatgtacctgttgccttaccagcaagctcagccatcatgccgttgatgtcaataccttttgcaataacgtgaccgtgaccacggtggtgtgagaagatgatgtcctcatctgtcaatccagcaataggtccaacagccgcagcttcttcaccgactgagaagtgagtcataccttgtacgaaaccgcgacgcactaatttgtttaatttcatgtcaacatcacggatttgttgcattttcaagaacatgtccaaatgttgttcttttgtgatagataccataatttcctccaaaggtttttctctttctgtactatgatagaccaatatttcacaaatggcaagtaattgaaccgttttctttttacagaaatttttgtgaaaaccttgatttagtgcgttttttcacaaatcattaaaagattcactttacttgtttgaaacttttttcacaaactttgaaataagcttgcacgccgtctttctttctgttaatataggtacggaggttcttatggaattcgatttatttcttatgatttgtaactacataggcactatcgcatttgctgtttcgggggccgtaaaaggatttaagaaaaagttagatatttttggaattagcttgctcggtatcattaccgccgttggtgggggaattattcgagatacgatggccaatcgcattcctgccgccttgactgatcctacagccatctatttatctctcggagtagcgattagcatgtacttgattgttatcaatctaaagcaggacaaaccacttgataagaagatgattcatttcctttcccagacaaaccttatctttgatgcgatcggtctagccatcttcgccctcattggagccagtactggcatctctctccaactaaacgctctaaccagtggtattctggcagctttgacaggtgtcggaggcggaatcacccgtgatttactcgtcaatgaaacacccattgttcttaaagaagatgtctatgctgtccttgcatttttctctggagtcctctatcatctttgcgttgtaaattggaaattaccacaaattccaaccttcatcactatttttaccatttctttaatcattcgattattggtaattaaatacaaaatcaatcttcccaatatggaaagcaaacgaaaggtctgagttcgtcaactcagacctttttgtattattattgattaccagccaccgtggccaccagcacctggtcctgttgctgtgatttgagtaatctgctcaccgttaactgtcacagtacctcctgtcaattcagcagttccgtcgaagtcaaaagcagattgagctgttacatcaattgtaccacctgagatataaatgtctccattagcatcaaaggcatccgtatctccactacctacagctactttcaagtcaccgccagttaccttgatgaagatttctgatgatgttgtacttgccgcattaatagcatcatctgaaccatagacatctaatgtaccaccattgatagtgatattagttccttccaaggcttctgctgattctgatactgtaatggtacctccgtcaattgtcaaagccgtctccgctttaataccatcatcacctgctgttacagtaatttcaccacctgtgatagttgtataacctttggtagtatctgtatcatttgtagacttgataccatcaccacctgctgttacattgattgtaccaccattgattgtcaatgaatccttaccacggataccatcatccactgcagtgacggtaatatttcctgaattcacgacaaggtcatctgtcgatacgatgccatcttggaagttgccttcaacggtcaggctaccattaccagtgatggtcaaatcagcttcaacatggatagccccttcaatattggtgtctgtatgattgctggtatctttcactgtattcgtcgtaccatctttgatttccaattcaacattgtcagcattaataacattgattgctgctgtatctgaacttgaaatctcagcacctgctagaatgatgcgaacattggcatctgtttcaaccgttacaccagctgttgttgaaccagttaaaatataggttccaccctcagtaattttcaagccatcatttgaaagcttcacttctgtcgttggaagggctgaccagtcaatagttgacgaacttgaatctgatgaagtgctattatttgaagttgtcgctacacttgtctgactagttgctgctgagcttgaagtagtcgttgaacttgaagtagatgaacatgctgctaagacaccaaggctcataagagtaacaccagagtaaagtaattttttaagatttgttttcataatgtagattccttttctttaggaagtcgtatcccttcctgatatgctcctagtttacctttccttcctaaaagaaagattaaagattgccaaaagaaaacttaaacttcttaggaactacaaaaggccgggaaacccagcctaggaataatcattgataaaatctatagcttaacccaatgcaagcttttcaactcaagcaagggagaagtttcaggattggtatctgattcagaaatccgttttaaacctggaatcatcgcattgtattgataaatgcgaaaaacaccagctccttcaaataagtatgttccatcctgtaaaggacgaagtagggcgtccggtccaatttcaaatccaagattgcggaaattatccaccaaacgtagactctcatcggcaagctgagtataaaggtcaattaagacatattctcccgacttgtccaaagctagaagcagctcctctgtaccatcatggttaacatcatacaaactataaaatattccactgtattcttgcccctggctagttaataagctcagatagctactggcctcatcctgattaattgcctcagcaggctgacccatattcgcttgataacgatcaataactgattggtatacttcacttagctcaggagtggtcactgaggatgcttgcgtctcggagctagatgctattgttgacgcttgctgcaaactagaaccatctgaaacttggcttgaagcactagaactagaactctcaccaccttttacctgattagactgacaagcagctaatagtacaaccgtggacactaacatcagtttactaataaatattttcataacttcctcctgtgctctatctttggtcttatactcttcgaaaatcaaaattatccgttgtcaacttgccttgatgagtgaaaagctccagtggaggttttcagcctgttaccatgaaataagatagtaacagagttctatcttcgacttcgtttcctagtctacttttgattttcattgagtattagtataacatctttccgagggcttgtaaacgccaccatatatggacaaagcatccgagccagaaaaagccgaatgttgccatccgacttttgttgttaatctttctgatcaagagcacgcaacatttggtcaattttattgccgtactcaattgattggtctttttcaaagaccaaatccggaattttataaagagttaacttacgaccaagttctctcttaatggttcccgtcgctttttcaagacccgtttgtgctttttgattatcggatgccaaattactcatgattgtgtaataaaccttggccgttgacaaatcgccgaccatctgaacatctgtaatagtcactccctgcacacgtggatcacgaactttcttttgcaaaatctcattgacttcgcgcttgatttccatcccgacacggtctgtacgaaaatgattcgccatattctttcctttcttagatgatagaaaagctgagtttccccagcttgaataatccaagtagattaaaaactattgctttaaaacctactaaaatctattaaattgtcacttcctcgacaaaatcacttgtctatgactttgacagtgagaaaatattattttttgatttcttccatgatgtaagcttcaatggtatcatcaactttcaagtcgttgtagttctcaatcatcaaaccaccctcttgggcattaccaacttctttcacgtcatctttatagcgtttcaaactagctagtttaccatcaaatactacaacaccatcacggataactcgaacacttgaatcacgggtaaccttaccacgtacgaccatgaaaccaccgattgttccaactttggataccttgaaggtttcacgaatgattgcctcaccaatgattttttcttcatattctggatcaagcatacctttcatggcatcttccatctcttcgataaccttgtaaatgatgctgtgaagacgtacttcaacatcatctgcttcagcttggctacgcgcttcagctgttggacgaacgttgaaaccaatcacaagagcatttgaagcttccgcaagagtaatatctgattcattgatagcaccaactgcagagtggacgatattgacacgtactccctctacttcaatcttttgaagcgatgatgcaagagcttcaacagaaccttgtacgtcggccttgataatcacattaactgacttaacctcacctgctttaagggtatcaaagaggttttcaagactaactcgttgcgttgcttgacgctgtttaagaagagcacgtttagcacgttcttcacctgctgcacgagctgatttttcatcttcataaaccgcgaaatggtcgccagccattggcgtttcgttcaaaccagtaatagataccggtgtagatggaccagcagttttaacacgacgaccaaggtcatttgtcatggcacgaacacgtccgaaggtatttccgacaacgattgggtcttgaacattaagtgtcccttgttgaacgaggagggttgcaaccgcacctttccctttatccaaatgagcttcgataactgtaccaatcgcacgaacagttgggtctgccttcagttcttggatttcagcaaccaaaagaacagtttccaacaattcatcaatgttttggttaaacttagctgagatttctacaaattcagattctccaccccaagcggttgagataacaccgtgctcagccaattcaccgatgacacgctctgggtttgcacctggcttgtcaatcttgttgatagctacaatgatcggcacattagctgcttttgagtggttgatagcctcaatcgtttgcggcatgacaccatcatctgctgcaacaactaggatggtcaagtcggtaacagatgcaccacgtgcacgcatagaagtaaaggccgcgtgtcctggagtatccaagaaggtaattttcttaccagcttcctcaatttggtaggcaccgatatgctgtgtgatacctccagcttctccagtagcaacacgagaattacgtagggtgtccaacaaggttgttttaccatggtcaacgtgtcccatgatagtcacaacaggtgggcgttctgtcatctcttcttcattgaggtagccctcttctacgaagaaacgctcaatatctgcgttatcgacctctaccttttctttcgcttcaataccataatcaaccatgaggagttcgatagtatctccatccaaagattggttttgagtcgccataactcccataaggaagagttttttcacaatttcagcaggttcacgtttgattcgttttgcaatttctgcgacggtcatgccagcagtatattcaaattcagttggcaattcgtggaacttgcgttctgtgacaggtttggcaggttggttagccttgccttttttatttttcttgttgttattccagttacttgttctttgatttctcacttgattttgactatttcgatttctttgttgtttccgtggaccatcttcttcgtcactattaaagtcacgttttttatctggtcgagcttgtttcttacgacgggtatctacagtagtttctgcaacttgctctggtaccgatgcaacaagtgcaggtttcacaaatggtttgctttccacaaccggttcttcaaacttaatttcttttggcttcttaggttgctttttagcttcctgagcctgacgaaaacgttcttcactggtacgagcatactccgcattttgttctgctttcaaagcagcagcacgcgctttgaagtcaattttaggtcctgctggttttgcagcctctctttgttcaaagcgagctaaccgacctgaacgattgtcctgacgacggttgtctcgattatcgcgacggtctccaaatcggttgtctttccgctcttctggacgctggtcacgacgattgtcgcggcgatcatttcgctcattgtttgaacgtccctgacctagttgacggttgtcacgacgatcctgatcagatttagcttgaccaccttttccttgattctgagctcgcttagcagcctgctctttggcccgtgcttcacgctctgccttaaagtttcgactctgtggacgatgtgaagctgattgtactgcacttgccgcaacttcttcttttactactggctgtgtttccttagctttttctaccttagctgtttccacttttggagtttcatcaaccttctcaggcttgctaacttttgccgcaactttagttgcctctgatttttgtcccccaaagctttctgcaaggcgtttagcacttgcttcatctacgcttgaagcatgacttttgacttcaaaacccaattcttgagccttagcaacaacttccttactgcttacgcctaattcacgggctatttcattcaatctcttcttagacaatgccttgtcctcctgttctattccataatagacctcatcttctttgtaaatccagcgtctgtcactgcaagaacttttctagccttgccgacagctgcactcaattccagtgttgaaaacactgttacaacttctacttgataggtatgacttttatctgttacttttttacttaaatttccagcagcatcttcggctaaaaacaccaactttgcctgccctttttgaatagcttcaacaaccaggtcctcacccgaaaccaggcgaccagctcgctgggccaaacctaataaatttaagatttgctgtctcttattcgagtccaagttctctcctcttgatcttatgatcaacataggcaattaattcatcgtaaaattcttcggccacttccatactaaaggaacgatcgaagacacgacgtttcttagcttggcttgcctcatcattgtcaagcttgatgtaagctccacgaccatttgccttgcctgttggatcgataaatacttgaccttctttattttttacaatacggagcaaatcccgtttgtcgatgatttcaccggacaccacagacttgcgcaagggtatttttctagcttttgccatggttgctccttttgccttattcttgttcttctgcgacttcttctacaacttcgtctgttgcatattgagttgcttcaaaagcttcatactccgatgctgacttgatgtcgatacggaatcctgtcaaatgcgctgccaaacgaacgttttgaccacgacgaccaattgccaatgacaacttatcatctggtacaacgactgtagcatgtttcccatcttccgtgtcaaacaatacttggtcaacttcagcaggtgcaagggcattgtagataaattccgcttcatctgctacccactcgataacgtcaatattttcctcagtaggaatcatacggtcattcttagcatcataacgagctgggtggaatttgctagtgattttcttaatatttgaaccaccacgaccaacgatagtaccaatagcatctacgtttggattatggctacgaacagccactttcgtacggtctccagcttcacgggcaacactcatgatttcaactgttccatcgtatacttctggaatttcctgttccatgagacgtttgatcatttctggatggctacggctgacaaatacgttaacaccacgaccattgtcttctaccttgtagacatagacttcgatgcgatcatgagattggaaaacctcaccaggaatttggtcttgttttgacaattgtgcttcaatcgtaccaaggttgacatagataaagcgattatcaaaacgctctaccgtacctgacataatctcattttcatgttgcttgtaggtattgaaggtaatggcacgcttttgtttgcgcatcttttccatgatggtctgtttagctgattgagcagctacacgtccaaattccgctgggtcttcttggaatttaattttgtcacccatttcataagctgatgaaatagccaaggcatcttttagactaatttctagtcggctatcaaatacttcatctactacttcacgaacagtaaatacatggaaatcgccttttttctcgtcaaattcaatcactgctgattctgattgaccataacggcgtttataagctgaacgaagcgactctgtaactgcatcaatgatatccgctttgttaatacccatgtcttcctctaaaatacggaaggcttctagcatttctttactcatgttgttttccttttgcgctcaaaaggtcctttcttaaagtctaatatctttataaaatactcatgaaagagcattataacttaacagccaaacgggccttagccaccgtctggtaaggaatagttacttccttcttacgagttttatccatatactccataatcaggtctgttccatcaaaggagagcaacgttccttcaaaaaccttgattttatcaattgcctgatagagtttgacatggatgtactttccaaccgccttctcaacagcatctgccgtttttaaaggacgttccaaacctggacttgttacctccagcatgtattggtctggaaatgggtctggtttgatagtgtccaaaatcggactgatcttttcggataaatctgccgtatcttgaagggaaattccaccctccttatcgacaaaaatcgataggacatagtcaccgcccattttaccatattccacatctaccaactcgtaaggagtttgaatagcgggggtaattgctgctgtgaccaattcaataattgatgacataaacacctcctatttttacagtcgctagaaatacattactcaaatagttcgcactatccaggactctctatttcctttgacagtaaactcccttgtactatcattcattctatatacagaaatccgtgtacagggaaagggttgactgacgccaaccccttttctcattattcacttccattattctatcatatctatccctatttgtaaaggaaaacgatggattatagacatttataatcttttagtttacttttagtactctctccaaaggtttggggaacctttggaggttggagatagggcgaagcaagttcacttcaatagctgcagacagcttgtacagtcgagtgactgtgcaaggttggagatagcccttgcggagcaagtcacccctgaagagtacggcaaagcgaattcaaacaatccagtggagtgtttgaacttagaaataaggaaacggaatttcctcttacgtcgaagtaataaaagaaaaactgaatgactatagtttattcgacaaaggaaaaaggtctctgttagacctctcctcattttccactaagggaattattgaaactgtgcttccacacgatagatgacttgacccttgtttgagaatttctcctcatactctgtcataacgttaccttccaaaccatccgcatgcaaatctagccaaacctgcttcaagaccatgccatattgagaaaaactagccaggctatactcaaacagaccacgattatctgttttgaagtggatttctcccttctcaggtaggatttccttgtaggtatccaagaatgacttgtaggtcaaacggcgtttctcatgacgtttcttaggccatggatctgaaaaattcagataaagctgatctatttctgccggtgcaaaatagttggtcaaactcgaaccatccacctgcaataattttatatttggtaaaccagcttcaagcacacggtccaaggcatagcttaacacggtcatctgaatatcaataccaatatagttaatatctggattttgcgcagccataccagtgacaaagcgacctttaccagaaccaacttctatgtggataggattattgtttccaaaaatctctgcccatttccccttacactcctctggattggagataacatactggggattgtttgctagaagctcactcgctcccttacgatttctaactctcatacttccttatagaaactctgacggaattgccgtagagcataaatttctttatttgcagccaaaacattgtagctttctacatgcttagctatttggtttagatagccaagctggccataccaataaaccttatttaatactgtgctgttatatttgtagccataagcccgaagccactcttcccaggactgacgaggaatataatgcgtcaaaatataggcaacatccaacatccgatccgttacacaagcggtctcccaatctgtcaaatacaccaaaccagacgtcgtttctacccagttactatgatgcaaatctccatgaacaaatgttgccacctcttgacggaatcttggtagattattcaataaatcttgacagatagattgcagataagaattctgtcccaatctagttggtgcctctttttgccaacgataaaccaaatcctgaggttccatataggtataattcatctgcaaagcctgattgagcaaaatgcgagaatagtgcattctcaccagtatttgacgaatctgtttactagtcatatcttgacgctccaaggtacgaccattcaaccactcctgctctacacgatgccccattcctacttcacgatttgctgacaaaacgggtggtgtaatttgctcacgcgcaagagcagacactatcggaggcatctcatacttcacaaagactggcgttccgtctgaccgtaggcctttaaacgctttgccactatttcctgcaatagactgtaattgtagcccactggtatcaaactgcatgcctttcctcctttaaaaattccttactattttactaattttcgtctatttagtcaatcaatttttttaattttagaggcaaatatatttcatgcaagaaaatccccacgagaagtaagacgactaccatcgcattctctttagaaaatagcagagcaaagcccaattccactactaatagactatataaaatcactctaagcaaattctgaagaccaattttcttggaatctttctccagaggatacagttgtgttatatattgataatcataatgcttgtaaagccccaacaactggaagacaagcaaataatgaaagactaaaactaggccgatggataaccacgattcttcaatggcaaatagggacaaaatcgccaacaacagtagacgtatcgtcaagcccaagtagtctcctgaacgcaagaaagcccgtaagtagagataaaaccaagtctgtctcgacttgacgagacgcaagattccattgagatagcttctcggtttaacagtcgtactgattcctttaaccgttgtaaataaggcaaagaaacgtaaaatagactgtttccttttttgttcatcttgaatagccttagaccagtccaatactccctgtgactgataagccactaattggcgcttgacaaaaagacattttaaaaccaacaaagtaagaagaccagatacaatcatccacaccggtaaacccagtttcaaatagattggtaacaaaacaagctgaaccaccacctgtatagaggaccaaaacaagaccgtgcgtctggctgcaacctcgagtccttgcagaatgtctttttccttggtcaataggaagatttgatcagcttcttctaaataagtcgcaattcttccggacaatagcaccagtagactgattgcaataaccaccaaaacaatcggcaacggattctcagggaatgacaacaataattgacgatattgcaaactcaaaaagcctaataaaaccatgagaaccaaaacaaaatggtcattcagaacatagcgcagatacttggaacaacgatttaaaaaatctagtcggcgttgttgaaacaattctttcatccagccactccttcttgcgtcaaggccagataaatttcattcagacttgcaccatccataccaaatgcgctttgtagctcctccaaatttccagttgcacggacctgtccctgatgtaaaatcacaaaagagtcgcacattttctcagctgagtcaagaacgtgagtggacatgaggattgaagtgcccttagatttttcttcccccaaaagagcgattaaatcagagatagccacagggtctaatcccagaaaaggctcatcaacaatcaacagactcggctccaccataaaagcacaaataatcatgaccttctgcttcattccctttgaaaaattgacaggaaaccagtccaatttctcatccaagcgaaacagttttaacaagtgctcaacacgtccccaagcttgctcccaggataaatcataggccattgctaccacttccaagtgctctttgagggttagttcttcatacaaacttggtgtttcagggataaacccaattttcttccgataattttcagccccttgtagcaaagttaggccgtcaattacaatctgtccttgatagggtgtcaaaagaccgataatttccttaatagtcgttgatttccctgcaccatttaaaccaattagaccaactaattgaccatcctcaacggtaaaagatacatctttcaaaactgggatattgacatatcctccagttacattttttacttctaacatacatttcttcctataatttgatataattattataacaaaaatcctagaaagaggttgccattatgtcggattgtattttttgcaaaattatttctggagaaataccagcttcaaaagtctacgaagatgaccaagtattagcctttttagacatcactcaggtcacaaaaggacacacattggttgtccctaaaaaacactaccgaaacgtgcttgacatgaatgaagaagctgcagccacactcttttctgttgtgccaaccatcgctcgtcagttaaaagaaaaacttagagctagcggtctaaacatcgttaataataacgaggaggccgctgggcaaaccgtctttcatacacacatccatctcttaccacgctttaacaatcaagatggattgagcattcaatttaaagccaacgcccctgacttcccagccctggctcaactggcacaagagctctatctaggagaataatatgaaacttcgtaatatcattttagccgtaagcgccgctaccgccagcttccttgcagtcacgcatcgggataaaattaccaaagaaataaaggaaaccaaacaacttctatcagatattcaactgagcaaggacaatattcaggaacaacttgccattatccaaagttttcaagagcccttgcaggaaatggcttctgacttacaatataagactcgagtctatcagcaaagtattgcaggaaacttggaagaaatccaacagattctcaaaaaataccagaatgagaataacactccctaacatctggaatttccaaatatataaaaatagaggttgaaaacaacctctatttttataggcttttagtactcgctcgtcaaagtaataaaagaaaaactaatgactacattattgtgccccgttttcatcaccgagtactggctctgttgaaaaatcggttacctgctcttctgttgtcacagtcgtagtagccgatggactccctatttctggatccaagctttctgcccatggacttgcttctaacagcaagagatttgtatatgcatcataaacgtttattggacttggcaatcccatctgtccttcgtagaccttcacgtttgtgactaagtcggtcttttcttctaagccgatagattttttcagaacattttgcatttccaatagatgtgtactggttggtaattgataatagattgcatcaaccatttgatccacaccgcgcaactgataggaattcaacttggagacagagtccttgtaccccaagagatttggaattgttacaggactaatctcaatgttggttcgcatattattagaaatggcagtcagaatcttcttatactgggtaaaaccgtctaactgaaggagtttttttataatagccgttataacttcacgttgacgtctctgacgaccaatatccccctcaggatcatcatagcgcatccgagcataaaccagcgcctgatccccatttaccaactgtttccccggctggacaatagaggtgtaggcaggctcatgttccgaaatggatatagggaagccaagagtattgtttacctcaatacctccaaccgcatcaacaagctcaaccagaccatccatatttatttcgatataacggtcaatgttaatatccatcatcttttcgatcgtggcaatggccattggtgcctgtccgtagctataagaatgatttagtttttcaaccgttcctgaagactccccattcgcttctgcaatctcaaccataatatcacgagtcaagctcatcatattggtttccttagtcttgggattaacagttaccaaaatcatcgaatcactacggccaccctcccaatctcccccgcgggtcgcttggtccatatccacccccatcagtaggatagttaggggctctgtcgcatcaatcggagttattttttcttctccatctagctgcttaaatgttttcgaaatagcatccgtagaaaaatttaacaagctggctccatatattaagccggcacctactgttaaaccaataatagccaaagacattaagaatattttttttccaattgtcatacttcaccaattaacttgcccatataataaagatcaagccattctccttcatctgttctagccccacctatctgggttccttcaatgttgaatcctagtttttggtataaatgtactgccgcctgattgcgaacctgaaccgttaattccaaacgcttcaatacatccatttcctctgcccaatgcaatacttcctccagtaaaatcgtccctataccgtgaccccagtaggctttttttactgcaataaaaatatttccgatatggctaatgcgaaactgcttagaggacttaacagaaattgcgccgacgacttccgaaccaaccttagccaacaggcacaattcacgaggattttcgatccctgcttcgaagatggtctctatttcatcaacactaaatcgaaaaccagtctcatccatgactagataatccgtttctctagcaacttgattcataaaatcaataaaagctgctgcatcagctggttcagcttcactaaaatacacttctttttcagacattttggaactccttcgctaaatcgctactttgagctccatgagattcgactgtcaatcgtcgaccatctccctctttctctatacgaatgagcaaatagtcatcaaatagactgacatccagtaattctccccactcgataaccgttagacctcctccatagagaaaatcatccaaatcaatcgagtcagggtcatctccaattcgataaacatctaagtgatagagcggcatggccccctcatactctcgaacaatcgtataagtaggactcttaatcatctgttcaatttttaaccccttggccaaacccttggtcagagttgttttcccagcacccaaatcccctgataatactagaacttgatttggcttacaggcctttccaattctctcaccaatggcaatcaattcattttcattctgactatacatgtctttaattataccatagccccagtagtttgtcataggtctactggaaattgtagacaagtcgacagaaaaaatcgcaagccagagcctgcgattttgtttattctacgctgaaaagatatggatagactggttgatttccttgatggatttcgacctcaacatcttcaaattgttcttctagctgttcagcaagagtttgagccaattcttcattaccatcttcaccgatgtagatagtcacgatttcgctgtcttcatccaacattttatcaaaggtagccacaagtgtctccatcatatctggattagaaaccacaatcttgccatcaaccataccaaggttgtcattctcatggatttcaagaccgtcaatggttgtatcgcggaccgcagttgtcacgctaccacttttcacctctgcgagagatgccgtcatcgcttcaaagttgctttccaaatcacgacttggatcaaaagcaagcaagctagtaaaaccttgtggtagggtcttagtttccacaaccttaaccgcaacttctgcaacctcagcagccgtctgagcagccatcaagatatttttgttgtttggcaacaagatgacattgcgggcattgaccaattcaatagcattgacaaaatcttctgttgatgggttcatggtctgaccacctgaaatcacatagtcaacgccttgtgatttgaagatttctgtcaaaccttccccagcagctaccgcaataatagcatactctttttgttcagccggtttttggaaactttctactttctcaacctgagcttcatgttgctcacgcatattgtccacttttaccttgaccaagctaccatattgaagacccgcttgcatgaccaaacctggatcttctgtatggacatggactttaacgatttcatcatcgttgaccacaaggagggaatccccaaggtcgttaaggtagttacggaattcttcataatcaaagtccttgacataagtaggcccctggcgaagagctaccatgatttctgtacagtaaccaaaggtaatatcttcagtcgctacatgacctgcaactgacttgtggtgctcagcattgatcatttcagacataacagcaggtgtcgcctcaaaatcttccgaagcaatatactcacccgtcaaagctgacaagaagccttcataaatgtaaacaagaccttgtccacctgaatcgacaacaccaacttccttcaagactggaagcatctctggcgttttcttaagagcacgattagcaccgtcaagagtggcacgcatgacctcaaccgcatcatcagtctcttctgcctttttcaaagcggcagtggctgccccacgcgaaacagtaagaattgttccttcaactggcttcataacggctttataagccacttctacaccatgttgaaaggcttgcgccaaatccttaccgtccaattcaaccttgcctttaacagattgaccaaaaccgcggaacaattgcgacgtaataacacctgagtttccacgagctcccatcaacaagcccttagaaagaatttgcgcaacttctccaacagtagaagcagacttatctgctacttctttagcaccattggtaatagtcatccccatgttggtaccagtatccccatccggaactgggaaaacattgagtgagttcacatattcggcttgtttattcagacgagttgatgctgcctgcaccatttcttgaaataaactagttgtaattttagacacaattattctcctacgactttgatattttggataaagacattgacggcatctacagagatacctagttgattttccaagttgaacttaacgcgttcttggatgttgcgagatacttcactgatttttacaccgtagctcatcacagtataaacatcgactgcaatgcgaccatcttccaaggtcttaatcacaacacctttagaataattttcttttctcaaaagtgcttgaaaattatccttgatcgcagacttactagccatcccaacaacaccgaaaatctcagtcgtagcaccgccaacaactgtggcaatcacgtcatcagtcaattcgatttggccgtctttagtattgattttaacagtcataattcgttacctcaaatagttttatcactccattttaccacattttctgctttctgtaaaaaacaagcttgttacatcggattttacaaaaacatactaagattagtagtgaggaaatctccgacgggagaaagtactcactactttttctttatgataaagtagaggtgtcttgttaagtcgagaactcttttgacgctagacgtcgcaacaaaaactggcaagacacctgttttagaaagaatgttatcaaagtatgtgggacgccagacgtcgagtattgaaaatgacatcactaaaacaaggaatcattcaagacaaagaggtaatatcatgcgagtagtttttgggattgatgtgagtaaggcaagttcagaagtggccattctagtcaacggcgagaaggtacataactacaccatgtccaatgatgccattggcttttctcggctacttggcgatttgaaaaccgtccacaagccagaaatcatctttgaagcaacaggtgtctattctcgccgtctccaaacttttctagatgataatggctatgcttatacacggcttaatcccttagaaactaagaagcaactggatagcttgcgtgtgcggaaaacagatcaaattgacgctgaaaaactggctcaatctcaatttgtgctgaatcgtaaacccacttatgtccaagaagaagtctaccaaaacttgcgggatctcagccgtttctatcagaatctgaccgaggatattgttcgagctaaaaaccgcctgcacagggtcttacaggtcactttccctgaattggaaaatatcttatcgacaccatctggcgaacaatactggaacttagttatagcttttccttgtaaggactgcgtacttgagttaagcaatgatgaactctcaaagagcatccgtctgtccacttcaaaacggatttctgacaagcgtgtggcttacttagccgagaagcttatagcactagctaatcaatcttattgtgccgtcaagaaaacctctccaatactggaagaggtccgttactatgcaaagactttatgaacagagacaagctgtcttagacgaaatggtggaactagctcagccattacctgaatatgacattctgctctctattcctggaatagctgagactactgcaacaagtattattggtgaactgggagatattcgccgttttcagtcagccaaccaaatcaatgcctttatcggtattgacctgagacactatgaatctggtaacttcctcgctaaggaacacattaccaagcgtggcaatccctacgctagaaagattctgttcaaatgcattcacaatatcgcttcagccagtcataccaatccttgccatatcgcagacttttatgagaaacgaaaaagacaatcgcaaacgacttcaacgaagtcgcacacgattgcctccatacatcgtctcattcggacaatgtattacctcattatgcataacaaactttacgattacgcttcaactcaaaatcggtaaaactgtttatgccatatcattgtaacaccttatcaaaaaatttcaacataaggtgttggttttgtatgcactttttacactaaaatttagtccaaaataaaacaatttccttattttgactattgaactcaaaatatttttcgtcaaataccttgatggacttgacaaatagtagaaaaaagagttcccaaaggaacccttttcacaattaacctaaacgctgcttagcatctgctgcacgttggaaagcttgtccgacatagttgatacagagcatcatcacaaggatgaagatggctgctggcaaccaaatccatgtcttgttttccaaaatatctgcattgcgagcattggcaatcaaggtacccaaacttggtactgtcgatggcagaccgaaaccaagataagtcaacgaagtctcgataccgatatttcccgcaaagttcaaggtcaagttaacgataatcaatgaacttaagtttggtaaaatttcacggaacataatcataaagtcgcttgttcccaatgtttttgatgcatttacatagtccaaacttgcctctgacaaagtccttgtacggaatagacgagccttggccgtccaataaaaggcactcatgatgagaatgaaatgatagattgtatagttcttgataactgtcacgaaaacaataatcaacattgtcaccggcaaaatcatgatgaaatcgacaatacgcatcaagaatccatctaaacgaccgccataataaccagaaatcagaccgacagaaatcccgacaatacttgtaataatcgtaatggtaaaaccgataatgattgagttacgagcgccgataatcagctgaccaaagatatctttaccaccttcatctgtccccaagatatagccgtcaacacctggttccaagtaacgtcccaaaaggttgactttcataacttgttcttgattcaacagaagtgcaccgataaagactgctaagagaaccgtcactaagataattaatgaggtcaatgcaagtcgatctttcataaactcccgcgcgatgacacggaagccacctggaggagttgaagcagattgtacttgttttttattttctttactcaccttactcctccttctatttcacacggatacgtggatccacgatactcatgataatatctgaaatcaatgtccccaacaaagtacccataccaaataccaacaataaagctaagataacactatagtcacgactagaaatagagttaaagaataactgaccgatacctgggtaagtgaaaatattttcaataaagatagaaccaccaattaatcctgtcaattcatagcccaagaaagatgcgattggtaaaatcgaattacggaaaatatgacggttataaacaactctctcaggaacacctttggcacgagctgtacgaacatagtcctgactcttagcatcaataatccccgtacggagatattgaatagtaactgttgttgacaaaatagccattgtaatcgctggcagaatcatatggtgtaaacgactgagagtcgctgcaaatccttccacacctccactaatcgaaccacgcgtcgggaaccagcccaaactaaagccaaacatccagagcatgagaatggcaaaaacgaaagttggagttgaaaatgtcaagaagttatacacgccaatgattttatctgcaagtgagttttgataacgacctgcaatcatacccaatggaagtgcaatcaaataagtcaataccatcgtcaagagggataatccaattgtattattcaagcgctgcatgatgacatcaacaactggttgtttaaaaataacactctgaccaaaatctccttgcaaaagattgcctacccagcggaaatactgaacagggattgggtcatagtaacctgccgcaatccgtttttgttcaatgattgctggatcaatattggggtcaatcaatcctgtaaagggatcccccggcatcatcttcgcaacaaagaacgcaatgacactcaaaataataatctgcggaatcatcatgagtaaacgacgtaatactgttttccacatcttagttctgacctccttctggaagggctacttgatgagtttctgagaaggatctcaaatcgtacacacgaccgttttcatcatagtattgaccttgcatttcttgatattctttttcagcagccaaacgcttttctttattcttcaatcgattgagtgggtcaatcgttggaatagctgacaacaaacgtttagtataaatgtgttgtggattattataaatatcgttcttatttcctgtttctacgaaacgtccgcgatacatgatgaacaattcatcacacatgtgttgcacaacaccgaggtcatgggaaataaagagatagctgagcttaaactcatcttggatacgtttcatataattcaagacctgtgcctgcacagacaaatccaaggcagaaaccggctcatctgcaataatcaaacgaggattactagccaaagcacgagcaacaccgatacgttggcgttgaccacctgagaattcgtgaggatacttaatcagagcttcttcatttagaccgattgtatccaagagttgaagaacttttttcttttcttcatctggagataaacggtcaaagttacgaattggttctgcaatgatgtccaagatacgttttttcgggttgaaacttgaaagagaatcttggaaaatcatttgaacatcacgattaaagtttccttttttaccacgtgatttgttggttacatcttgtccttcatagataatctgaccagaagtggcacgctctaaaccgataattgccttaccaatggttgatttcccagaacctgactcacctaccaaaccataggtttttccttcttcaaactcaatattaacaccatccacagcatagacatggtccgtcacacggttaaagaagccactacgaattggataatggacttttaaatcttttacttcaataaatcccactattaggcctccccttcaaaatagaatgtctcatggcaggtacaacgaacaaagtgatttggacctacctcgtgcatgctcggattctcttcatgagcctctgctccaatccacggaatacgcggagcaaaacggcaacctttacgaaccatttttgtaatcggcggcacaataccttcaataacatgaagatcgcctccttcgctacctgattgaggatttgacttcaagagcgaacgtgtatatggatgtttaggattggtaaacaattcttctactggcgctacttcgacaaactgaccaccgtacatgaccgccacacgatcagcagtttctgcaactactcccaagtcatgggtaatcaaaataataccagaacctgtctccgcttgaatatcatttaagagatccaagatttgtgcttgaattgtaacatccaaggctgttgtaggttcgtccgcaataataattggcggtttacaagacaaggccatcgcaataatgatacgctgacgcataccacctgaaagctcatgtggatactgtttaaatgtccgcttaggatttggaatacctacctgagccaagagttccaaaactcgctctgtacgagcattggcatccaaatcagtatgatagaacagtgcctcatcaatctgtgcaccaatcgtcatcaatggatttagagaagctaagggatcttggaaaatcataccaatatcattaccacgtactgtattgtacttagcttcatccatgcccatcaattccatatcattgtactggatgcttcctgtgattttggtattcaaagggttatgcaagcccatgatggtcgttgccaaagttgattttccacagccagattcccctacaattgccaaaatttcatttttttgcaatgagatgtcaacaccgtcaacagcgtcaaaataatcatctccaatacggaaaccgacgtgtaaatctttaatgtctaaaagcggtttttcggtagccacgctttttcctcctttatgtgccagctaatcaagctcaatcaattcaatagccttacgattatcaagttcatataacgtttgattaactgactttatataactactctagaataacatatttctaccaaattatcgtttgatagcgattacccagaagtaaaaaatgtacctatatccaatcataaatcaagaccatccctatcactgtctcaattaggaattgagtaggttaatgttcttcatcttgagtttttgttagtagggactcatttttgtgtactgagtgtactgagtctactataccacaattatctgaaaattccaatagcaatctgaaaaaagccaatcaaattggctttttcagattctattgtcttctaacaaattattctgccactacacccttatcagctgtcaattcgataccctcataagcaagacctgtacccgaagctgagccgtattttgtatcatagcttttcacacgtttattaacagcagtaattttttctgactcaaacgttggaatagcaaatgcttgctcgtgagcatatttttgccaagccttatagttctcaacgtttttcttatcatcaaacgactctgctgagctgatagcttccaataacttggtgttttcatcggacacgaaacgtgacatattgaaggctgcgataggcccccatagaccacttgggtttggatcgtaacctgttgaccatccaccagcatacatatcaatagcagcatcattagcctgaactgagttatagaacgacttaccttcaactgtacgtcctgtgtaaagttcgacattcaagccaacttctttccaccaagcaatgtattgttgtacaagcgcttcgttagcttcagtacgtttacgagccgcaaaggtaatcttgaatgccttaccatctttgccttcacggataccatcaccatctacatctttgtagccagcttcatccaaaagctttttcgctttttcaggattgtatgaatagccttccaactctgaatcatgaatatcgccgaagaatgagataatcaatgattttgcagggtggtaaagaccgttgtataatgacttaccagctgtcttggtatcaatcgcataggcaatcgcttgacgaagtttcacatcattcatcttggcattttcatccataacgttcttaccagctgcttcgtcatatttaccaaaattaaacgagatatactcataagacgactctaactgaccaacgatattcaagttagaagcatccttatatgaatctaactgatcaaccggcatttctgcgatatcataattccccgctttcatttcagaaacaatagtatcaggagatacgatgtcaatcttcaatgagcttgtttttggtttcgtacccttgaagaagtattcgtttggtacgtaagtgatagactcaccattgacgatttccttaatcttccacggccccataccaacaagcttcgcagtacgtgagtattcgctcttttcccagtctgcaacagggatgtctttatagatgtgttctggttggatataggctgggacatcaccacctgcatacatcattgaaggtgacatttcttttacagttaattctactgtatagtcatcaactttcttaataccagagatgtctgatgcttttccatcaacaaattcttgcataccttcaatattcaagaatttatcatcaaaacgaatacctgtatagtctttgcttgccatcgacttaattgtaaagatgtagtcgttgattgtgaatggctcaccatctgaccacttgtaatccttaccagtcaagctgactgtgattttcttgccttttacatcaaattcagccttggcaagacctgagtcgtccaacttacgttctccgtcgtaaccgaacattaaaatatcaaccataccaccaaatgttgaatcagtagtattctcagtcaactcatcaattaaaagacctgatgaagttgtaggagatacccaagcatatttcaattgagcatctgcgactgctgttccatcttgttttacttcagccgggaatgacaattcctgttttgctgcacctgattgttttgaaccacatgctgcaagaacagatgctgaaaggagagtcacacctgcaagtgcaaaaagtttcgttgtctttttcataaaacacctctgttttctttttgtttgacacttattactatgtcttataaaaatcattatatcataaatttttcttaaataaagtctttttgtcagaaaattttgtaaaaacatattttttcatcattttctcattttttacatgttttttccaaatttttctcacatttcttgtgatataatagaataaaataccccaaaaaggaatgattatgcgtaaacttttactaacactcactacaatccttgctgtttttttaacttccacacctattttggcagaagatttttctgttgcagccaagcatgctatcgcggttgaagtaagtagcggcaaaatcttgtatgagcaagatgccgaaaccaaagcaagcattgcttctatcagtaagacattgagcatttacctggtctacgaagcactggcaaagggggaaatcactttagatactatggtagatatttctgattatccctatagcctcacttctaatactgaattaagcaatgtcaatctagatgaacgctcctattctgtaagagacctattaaacgcttctttaataacatcatccaacagtgctattattgctctggcagaaaaaatagccggtagcgaagctgcattcgtggatcgaatgaaggcaaaagtccaagaatggggaattaccgatacaaaaattgtcaatgtatccgggctagataataccgacttgggtgaaaatatttatccaagttccagtcctgaagatgtaaatatgttttcagccctagatgttgctatcatcgcaagacgattaatactcgactatcctcaggtactcgacattacctcgctaaacgcctacgattttggcggctacacttactatagtaccaaccaaatgctgagcgacggcactcacgctcgtggaggggtggacggcttaaaaacagggacctcaaactcggctggttcaagttttcttgcaacaactcaacaagctggtatgcgcattatcacagtagtattgaatgccaatgatgggctgacctctccagaaaatcgctttgtcgcgacaaatgatttgatgaactatgtttattctaacttttcgcttgttacactagtaaaaaaaagtgaagcctttggagatagtaagataaaggttttcaacggtgaaaaagaaacaagtcctgttgttgcagcagcagatttaactgttgttcaacgaaatcaaactgataatgtccccaccgcaactttcacaacggatatcaaagaaattgatgctcccctcaaagcagggaccttggtcagcaaactacaactgaaagatcaagatctcattggaaaaggttatatttccgagcaaactggtgtcgatatgattatccctagcgatatgaaagaagcatcctggccattctcttggtggaatcaatttgtccgctatgtcaatgaaaaattataaaaaaatagtatgtcgaacgattttcgacatactatttttttatcgtagagtgacaaccgctactccttatctccagcctcggttggagagtgagttggtgagagttcctgacagaaaatgacgagcgtggaaggtaacaattccattcgtcaatttataaagaagagctactgccgtcgctcctcatctcctacttcagtggggagtttgacgggcttgaacagctttaaagctgttcaagttcgcggcaaactatcccactgaaccctccatctcataggcaatcagtctgttgagttcgactgcgtattccattgggagttcttttgtgaatggttcaacaaagcccatgacaatcatctctgtagcttcggactcggacaagccacggctcatgaggtagtagagctgttcttctgagatttttgatactttggcttcgtgttcgagggccacttgtgagttgtggatttcattaaatggaatggtatctgatttggaaatatcatccataataatggtgtcacactcaatgtggctgatagacttggctgagtttttcgcaaaagtgacttgaccacggtagttgacttctccaccaccacgggcaatggatttggacacgatagaagatgaggtgcgtggggcgttgtgaatcatcttagcaccggtatcctgtacctgacccttgttggcaaaggcaatggacaacatggttccacgtgccccttcaccttctaggtaaaccgctgggtatttcatggtcgtcttggcaccgaggttgccgtcaatccactcaactgtggcatttttctcggcacgggcacgcttggttaccaagttatagacattgtctgaccagttctgaatggtggtataacgcatataggcaccttcgtgggcgatgatttccacaatcgctgcatgaagacttgccgttgagtaggtcggtgccgtacagccttctacgtagtgaacacttgccccttcatctacgatgatgagggtgcgttcaaactgacctgttccttcattgttgatacggaagtaggtttggagtggaatatccagcttgacaccttttggtacatagatgaaggttccacctgaccaaaccgctgagttgagggcagctagtttattatctgacggcggaacaagttttccaaagtattttttgaagagttctggatgttccttgagagccgtgtcggtatccgtaaagataatgccatgcttgtcgtactcttccttcatgttgtggtagaccacttctgattcatactgggcagaagcacctgctaggtaggcacgctcggcctctggaataccgatgcgttcaaaggtttccttgattttgtctggtacatcatcccagctgcgtgctggcttatctgacggtttttggtaatagacaatgtcatcaaaatccagctcagacaagtcggctccccaagtctgcatcggcattttcttgaaggtttcgtaggatttcaaacggaattccaacatccattcaggctcgcctttgatacgggacatttcacgaatgacttcttcgttcaaacccttacctgtcgaagccaccagttccacgttctcgtcatggaaaccgaatttgtattctccaagatcaatcggggttggttcaattctttcttctgacataatataagatactaagccccttaagaaagcaaatgaaaaacaggaaatcgacttcgtgtgcaaacacacgcggagatttatcttttttcaaaagcttttagggcgagttcaatttcatttccaatcagaaactgaacaatcctttctgtatgattttcatttttgtttattcgatgatgctcagtaagcatcttcacttcgttcgattgctttcttcaagacactaaacttggttggaactaaagttcctaaccaagtaacgcaaggttctaatcaaccttgctaagtggcttactaattggctgattttggtaatatcgaccaaaatcgctcatgtcgcagttacccttcattcagcactgtcacttcgttccagtgctttcttcagggcattccacggtaatgtggcacatttgatgcgttgggggaatttggcaacacctgcgaggagggaggcgtctcccagttccttctggcgtgggtcttcttgacctcggaccatttgtgagaagatttctgctagttcttgaatctgactgatttctttgccaagcactgcttcagtcatcatagaagctgatgcggttgaaatggtgcagccaacgccgtcaaaagcaatatcggtaatcacatctttttcaatcttgacggacaattcaatcacatcgccacaggttgggttgtggagttctaacttttccactccgtccaagcttccgcgatgacgaggcgacttggagtgttcagacacaactgccatataaagagagtctaatctagatagggccattgaaaaactcctttgtcttgatgattgcctcgaccaacttatcacagtcagccttggtattgtaaatgtaaaaacttgctcgtacagtagcaggcacctgcaaatatctgagaagcggttgggcacaatggtggcctgcccgcacagcaacaccttcatagtccagagcagttgccacatcgtgtggatgcaagtcgtccaagttaaaggcaataactcccgtccgcttggacaggtcctgactgccataaatggtcaagcctggaatagcctgcaattttggaaagacatagtcaaccagttctgcctcgtgggcctggatagcgtccataccaatttcggtcaggtaatcaatggccgctcccagaccaatcgcacctgcaatattgggcgttcctgcctcaaacttccaaggcaattccttccaagtagctgactgctcatagacaaagtcaatcatttcaccgccgaattcaactggcgacatgagattgagcaattcttccttgccgtagagaatgccaattcctgtcggtcccaacattttatgacctgaaaaggcatagaaatccacgtctaattcttgcacgttgacgcccatgtggggaactgactgggctccgtccaccaccaagtaggcaccgacttgatgcaccagctctgctatttccccaataggaaccacgccacctaggacattggatacgtgggccagggagacgaacttggtcttagaagatagtagcgaccgcagatggtccatgtctagctcgccgtcttttagggtcacatagcggagcttagcacccgtttgctgacaggcttgctgccaagggatgatattggagtggtgctcttggaccgagatgatcacttcctggtctggctggagaatttcctttgcaaactgagccacccagttaagactagtggtcgttcctctggtaaagagaatttccttgctagacttggcctgaataaaatctgccaccttctgcctagccgcctcgtagcgagtagttgcccgttccgaaagggtgtgaacgccacggtggacattggcattgtccttctggtaataatccgccagcacatctagtacctgctgcggtttttgagtggtcgccgcattgtccaaatagaccagcggctcatcgttaacaacttggtctaggattgaaaattccttgcgaatgcgttccaaatccatatcttatctctttgttagtttttcttcaatcacggcaatcagttggtcacgaacttccttaacaggaatttctgtgataacagagcctaggaaaccacgaacaaccaagcgttcagctgttgctcggtccagaccacgactcatgaggtagtacatgtcttctggatccacctgaccgattgaggctgcgtgtccagctgtgacctcattctcatcgataaggagaattgggttagcatctgagcgagccttatcagacaacatgaggacacggctttcctgctgggcatccgctcctttagcaccgcggacaatgtgtccgatgccattgaaggtcaaggttccactttctaagataaccccatgttgcaggatgtgaccgaccgaattatgaccgtagttggtcacgcgcgtatccacaccttggacctgacgacctgatgacagtccgacaactttgaggttggcatggctaccgtttccttttaattcgctgtccaaatcggcaaccacatttccttcgttgagcagaccaatcgcccagtcaatcgttgcatcgtttccgagatagccgcgacggttgaggtaggtatccaaatgcttgccaaggcggtcaatggccgcaaacttgatttggctaccagcaagggcgattacttccacgacaatattggctgaagtcgttgctgcgccgtcgcccaaactttcaaagcgttctagataattaagcttggcattttttccagcgatgatgaggacacgtttattaaaagcaactggactagtgctgtcttggtagaaaagggcctcaactggctggtcgatttcaacattatctggcacgtagaggacagctgttgcgttaaaataggctgtgttataggcggctaatttgtgttcatcgtaggctacggcagcgccgagatacttttcaagtacatctggaatgacatccatagccgatgcgaagtcagtaaagactacacctttctctacaagggcaaccggcaactgttctagaatcgtttggctgccaacttgaaccaacataggattgtcaccgatagctgtaaaatctggaactgccccgatttcatcatttgtagctaggcttccgtcacctagattccaacggtgaaacttgacccgctcgataaccggcaagtccagctctgctattttgtcaaaagccttaagacgcaggtctgtcaaccaagttggttctgcctgcaaggctgaaaattcttgaatcttttctttggtcatagcttcctccaaagacttaaatgtcatcttctttgtagtcgatgccaagctctgctgcgacttggacataaccttctttttccaagcgttgtgccaattctggtccgcctgacagaacaacacgaccttccatcatgacatggacaacatcaggagtgatgtagttgagcaagcgttggtagtgagtaataatcatggcaccaaagccttcaccacgcatagcatttatcccctttgacacgactttaagggcatcgatgtccaaacctgagtcaatctcatcaagaagggcaaaagttggttccaacatgagtaattgcagaatctcattgcgttttttctcaccacctgagaaaccttcgttgaggtagcgctctgccatttcctctttcatgttaaggagctccatcttttcatccaacttagtaatgaaatcacgaacagaaatcttgtcttcgtcttccttaccagcgttcattgcggcacgaagaaattccgcattagtaatccctggaatttctgacgggtattgcatagccaagaaaagacccatacgggcacgttcatcgacttctaattctaaaatattgacaccgtcaaacagaatctcaccttgggtaacttcataacttggattccccatgatggctgctgaaagggtggatttccctgttccgttcggtcccatgatggctgcaatttcacctgttttaagggtcaaattcacacccttcaagatttctttgccttcaatttccacatgaaggtctttgatttctaatactgacatgctgtgctccttttcatttttgtcctcttcaaaaaccacattaactgaccaagctaactagatacaccgataagactcaactttggcagtggggaaagagctcgaccattcatagaagagtccgtcaacaagtcctagttttaagttgttgagctgggagtgggaaagaactcgaccatccatagaagagttcgttttcccacccccgcacagttgattaggtcagatttggagtgtaaaacacgaacaaatctgccaatcaaccactactgcgctaagatgttgacactaacgttgagaagcggtacagggcttgagcccagcttcactccactggactgttaaacccaatcaaccactactgcgctgagatgttgacgctaactttgagaagtgatgcggggcttgagcccagcctcttttcttgttaatgatgattttcagagagtgttaatctataaaatagtcttttctgacaattttaattaaccatatccactatattatatcaaaaaaagagcctgacggctcttatcttgtttagaaagattcttattttctttttttctcttcacagcactttttatactttgcgattttttcttgacggtaactactattaccaataaaccgaagaagattgagcaatggagttctattaataccaaagatgccaatcaattcacagagaatctcaatccccagtcccatggtcaccaataggagaatcccccctattctactcgaaacattgagcaaaagagaggtcagggagaataagaaagagatggcgtaaatcaccaagactgtgccacgatgagtaagtcccagagagagcaagcgatgatgcagatgcatcttatctgcttcatagattttttgcccagacaattttcgacgaatgatggctactacagtatccgtaataggcactccaagaataatcatcggagtaaccactgcaacagctgtcgaatttttcagtccttgaagggacaagactccaatcataaacccgatgaagagggcacctgtatcgccaagataaatgatagcaggattatagttatacggtaaaaaacctacaatcgccgcaaccaaaacaaagatggttaaggtcaaaaaaatattgctatcatgcaaaaagaaataagacacaattcccatcgttgtcagggaaataatcgatactcccgaaaccagaccatccagaccatcaatcaagttgactgcattcgtaatggaaacaatccaaaggaccgttaatagaaaagagagccagacaggaaattgaaggaaaggtcctccaaaaggaatcttaaagctatcaaaacgaaattccgtaaaaatccaaataatcgtcgctgcagctagaataccaaacattttaggagcaggctttaactccttgacatcatcaatgaatcccgtaagaacgataatgctggatgctaggaccaggggccagatataatgcaagtaagtgccatggtaattgacacgggtaacaattcctggtaaaaaccataggacagaaatggtaaatgccacaaagatagccagacctcccgctgaaggcatgggcaccttatttattcgccgtgcattgggattatcaactgctccaaccctcagggacataaaacgaaccaagggggtcgcaatggctgatatgaccatggttgtaataatgaccattatgtattttagagcaaaaggaatcatactgtcggaaccttcctaagctcctcaattgccgcaagcggaagcatcaaagttccgtgttcttgtaaagcaggtctggtcaacttagtatcattggtaaattccaacattcttgagagaatgtagcctggatactgcttggaacgattttctacattgataagaactgtcaagtagtagtgaccatccattttatataattccgattcttctactggataatcaaccgtaccaacaaaagtaaacagatcctctatcgttggaaattccaaaatatagtaaatatagcgctcctgctcctcttcatctgcttcttcctcttgctctacctcttccaaatgacgaacagctgttgcatccggtgcacttttctcacgaacggtttgctccaaactcttgaaaaactcatctggagtcatacttgcgacatcaccaagttccgacaaatctgtaaattcatcaaaattcaagttctgatccaaatcagatttggtaacaaagatgtccacccgatctggcttcggagtcacacgaaaactcagcataccgctttctcggaaagtcattggtaaatccaattcatccaaaacagtgtaaaagaactcctctgtcttttcttgcggaatgagaaagtccgaaagttccattcctctctcttccaaatcatctaattttatagtgattttcaaggttgaatcactaatttgctttactttcataactacctcattcattgattcatcaattttttaaaattgattgatcattttcaatactcatacatatcttccaccattatactaaaaccaagctcgaaagacaaaagaaaagcaggtctccctgctcttaaaataaaaatgtgataaaggcataaaccaataaaatcgcccctaaaatgatgcggtagtaaccaaagaccgtgaaatcatgttttttaacaaagtctgtcaagaaacgaataacaactaaggataccaagtaagccgtcacactagcgactagcaagatccatacctgctccatattcaggctattgccatctaagaaatatttaacagccttcaaaccactataaccaaacatggttggaatcccaaggaagaaggtaaaatctgccgccacagatcggctggtccccaaaataatcgctcccagaatggtcgcacctgagcgactagtccccggaacgatgcttaagacctggaaacacccaatcaacaaggcagttttataagacattttcgctaagtccgtcacctgtggctctatacctctgttacggttctcaatccaaataaaggcaataccgtagacaatcaaagcaatcgcaatcggtaccataaaattgaaatgtgcttcaaaccaattatccaacgggactgcaattaggatggacggaatacaggcaatgacaaccttggcccacaattgccaagtcaattgaatatcacgcttggtttttccaggctgaaatggattcaattttttaaagtaaatagtcataactgctagaattgctcctagctgaatgacaatattaaacatttctaggaagttcttactttggtttaatttcacgaactcttgaaccaaaatcaaatgccccgttgaagaaactggcaaccattccgttaccccttcaatgattcctaaaaatatagccttcaacaattccaatagcataaaaagctccttttcatcaattctctacattatatcataaaaaaactccctattcatagtacaaggatattgaaatttgtcagaatttttaataaaatggtgtaatagcattttaaaggagacactatgaaacgtaaactcagtatatttctgctgaccctaatcgctgttttttctgtaacaacaggggttcgggcagacgaatacctgcgggtcggtatggaagctgcctatgcaccatttaactggacccaagaagatgatagcaacagtgccgttcctattgagggaaccaatcaatttgccaacggatatgatgttcaggttgcaaaaaaaatcgctgcatccatggataaagaactcttggttgttaaaaccaagtgggaaggcttggtccctgctcttacatctggtaaaatcgatatgattatcgccggtatgagcccgacagaagagcgcaagaaagaaatcgccttctcagatagctactacacttcaattcctaccctggttgttcgttctgatagtcagtacgcaaacgcaaccagcttggaagattttgctggcgcaaaaatcactgcccagcaaggggtttacctctatgatttgattgaccaaattgaaggggctaacaaacagactgccatgggagatttctcacaaatccgtcaagctttagaatctggcattatagacgcctatgtttctgaacgtccagaaggtcgtacagcagaagctgcaaataaagctttcaaaatggttgaattggcagacagttttgaaaccaatgccgaagacgtgaccattgctgtcggtatgcgcaaagatgacgagcgtatcgctcaggtcaacgaagtcttagcaactatttcagaagaagagcaaatcgcacttatggatgatatgattgaaaaccagcccgttgaagaagccagcgagggcgaaacacctagtttcttcgcccaagtttggaatattgttgttaacaactggcaacaacttctgcgtggaactgggatgacattactcatttccatcctcggtacaattatcggtactgctatcggtctcctcatcggtgtcttccgtacagctccaaaagcagcaaacaaggcgcttgctattggtcaaaaagtgctcggttggattatcaatatctacatcgaaattttccgtggtacgccgatgattgtacaatccatggttatttactatggtaccgcccaagcattcggactcaatcttgaccgcacacttgccgctatcttcattgtatccatcaacacaggtgcctacatgagtgagattgtccgcggtggtatctttgccgtcgataagggccaatttgaagctgctactgctctcggatttacccataatcagaccatgcgtaagattgtccttccacaggttattcgtaacatcttaccagcgactggtaatgaatttgtcatcaatatcaaagatacttctgtattgaacgttatctcagttgttgagctctatttctcaggaaatactgtcgcaacccaaacctatcaatatttccaaacctttacggttattgctattatctacttcatcctaacctttactgtgacacgtatcttacgcgcagttgaaaagtattttgatacagatacatacacaacaggtgcaaaccaaatgcaagtcgaggtgccacatgactaaaaatgtaattcttgaaatcaaaaatctaaagaaatcatacggacaaaatcaagtcctcaaagacatctctattagcgttgaaaagggcgaggttatctcaatcatcggttcatctggttcggggaaatcaaccttcctccgatctatcaaccttttggaaacaccaacagaaggacagattctataccacggacaagatgttttggctaaaggatatgatttgacgacttaccgtgaaaaactaggtatggtattccaatccttcaaccttttcaacaatctaaatgtattggaaaatgccattgtagcacaaactacggtactgaaacgagatcgagctgaggcagagaaaatcgccaaagaaaatctcaacaaggttggcatgaccgaacagtactggcaagccaaaccaagtcaactctctggtggacagaaacaacgcgtggccattgcacgtgccctatctgttgacccagaagttatcctctttgatgagccgacttctgctctcgatccagagatggtcggggaagttctcaaaaccatgcaagatttggcaaaatcaggattgacgatgcttatcgtaactcacgaaatggaatttgcccgtgacgtatctgaccgcgttatctttatggataagggtgtcatcgccgaagaaggcagccctcaacaaatctttgaaaatccacaggaagaacgcacacgtgaattccttcagcgttttcttggataaactcaatctattccatagaagactattaattaccagtttcaaagctggtaagtttttttagactaaaaaaaagaggaattcgtaaaattcctctttttggacatctctaaatgaaaccatttagattagttttcaaatttcttgtggtttttgtcgtaaaaatcaatcaaacccaaggcagttgcaaatgaaatattgtcaatcttagcgcgaccttgtgcaagagcgataactgacatttcacgagcatttgtttccttactgatacggtaacctgtgattttcttttcacgaacccagccgacaacagcggctactttttcgtaactagtcattagaaacccctttcttttttattcgtgcaatttagtataatatgttttaacctattttgtcaagtaaaatgttcgttttttaccatcattttgccctaagagatgatagtatttgcgtccttatgtcttcgaccccctccggattccccggaaggaagatagtttgattacctccttgtgcaaaattattgagagtatccaagtattggttggtcagcaagatagacataatctgctcttcagataggctaacatttgattctttcagttcacgaatcgaatctgccagtccgtctacaatcgccttacgttgttgtgcaatacctacaccatgcaagcgatccttttcagcttctgcttctgctgctgtgacaatttttatcttgtcagcttctgccaattcttgggccgcaacccgtttccgttgagctgcgttaatttcattcatagattgcttaacctcggcgtctggctctaccttggtaattaaggttttgacaataacataaccgtaggttgacatttcttctgctacttgtttttgtacctcaagtgcaatctcatcctttttctcgaagagctcatccagtgtcaatttaggcacagatgaacgcagggcatcttcaatataggacttaatctgtgcttctgggtgcatgagcttgtaataggcatccgtcacattattttcatttactcgatattgagttgccacattcattgtgacaaaaacgttatcctgcgtcttggtttctaccacaatttcactttgcaacatccgtaattgaatgcgggctgcgatgacatcgactccaaatggtattttaaagttaatacctgaagtagatgttttttggtatttcccaaagcgctcaataatagcgaccgtctgctgcttgacaacgtatagccctgaagcaatcaaaatcaaagcaatcagtacaaagaacaagaaactaccaataaaaacaattggaccaaacaccataatgacctcctaaactagcattttataaagcgaatcattttcatgaagattgatgtactggggatcaaactcttccaagcgagaaataaactgcgtataatctgttttatctcctagggcaataccgattagaaccggtcctgttcccttattggcacgtttgatatattcaaaacgagtaatatcatcatttggccctagaatatcatttacaaattcacgaagagcccctggacgttgtggaaaattaacaacaaagtagtgtttaattccctcgtagataagcgcacgttcctccatttccggcatcctgttgatgtcgttattaccaccagaaatgatacaacaaatggtttgccccttgatttggtccttgactacctcaagagctgcaatcgttgctgctcctgctggctcagcaacaatacccagcttagaatagaggtctaaaatagtcccggaaatccacccttcatccacaccaatcaggcgatctacgtatttccgagccacttcgtaggtcgacttaccgactttctgtaccgcaataccgtcagcaaatttatcaatttggtctaatttaaccggacgacctttatcaaaagccgctttcattgaccgtgccccacttgcttcaacaccaacaatcttaatttcaggtgcatgttctttcagataggccgaaacgcctgcaaccagaccacctcctcctatgggaactaaaatttggtcaaaactaatggtttgctcttccgcttcttccaagatttcataggctactgttccctgaccagcctgcacattttcatcatcgaatgggtctataaatgttttcccactttcctgagtataatcttgtgctgccttggctgactcatcgaaggtatcacctacgagccgaatctctacataatctcctccgaaaaatttaacctgccctattttttgttgcggagttgtaatggggataaaaatcgtagcaggaatttgcatttcctgacaggtgtaggccacaccttgagcatggtttccggccgaagcacagaccactccgcgtgacttctcatcatctgtcaattgtgaaatagcataataggctcctcgaattttaaaagagcgaacacgctgttcattttctctttttaaataaatagttgcaccatatttttccgacaagtatcgactataatccaagggggtacgtactaccacgcgcttaagaacggagtatgcttgttctacattttttgctgtaatcatagttccattaatttctttctatatttattgtatcaatattccctagaaattcctagtatttaaactattattatgtcattttataaaaaccgaacttttttatttttttaatgtattcatgaatgaaatgggcaaaagagccggaaaaaaccagctcttttattcattttcagagatagggaaaaaagggaatgacatcccctcatccgccaactcaaaccttaaatgtattgccatcactcaaagtaaagctgactatcctcctatccaccatgatagtgtttaattatagattttgaatgcgtcgtcatcattgcgtccgacaaatggcattgctttgcggagctctgcacctactttttcgatttcaagattctctgcttctttacgataagcttccatacgtggacggcctgctttatagtcatttacaaagtcatttgcaaatttaccagattgaatatctgcaaggactgccttcatgttttctttgacttggtctgtaatcacacgtggacctgatacatagtcaccaaattcagcagtgtttgagatagattggcgcattttcttaaagccaccttcgtagacaaggtcaacgatgagtttcatctcgtggagaacttcgaaataagccaattctggtgcataacctgcttctgtcaagacttcaaaacctgcctgcataagggctgtcaaaccaccgcagagaacagcttgctcaccaaacaaatcttcttctgtctcttctttgaaagttgtttccaaaagaccaacacgggctgaaccaacaccttttgcccagtccatcgcaatatgttttgcattgccagttgcatcttggtaaacagcatagagggctggtactccaaaaccttcttcaaaggtacggcggaccaagtgacctggaccttttggtgcacacatgaagacatccacatctgctggtaccttgataaattcaaaatgaacgttgaaaccatgggcaaaaccaagggcattgcccgcttccaagtttggagcgatttcttcattgtaaaggtctgcttggatttcgtctggagccaagatcatgataacatctgcttgttttgctgcttctgctacttcaaaagtttcaaaaccatcttcttttgccttgtcaaatgacttacctgcacgcacaccgatgatgacatcgtgtcctgtatcacgcaagttttgagcatgggcatgaccttgtgaaccataaccgataacggcgatacgtttaccgtcaagtgctgctactgttacatctttttcatattgcattgttactgtcataattttttctcttttctatttttatttgtagttttggatgttcaaagaaaatgaaggctagactaggcgatgtaggcgaagatagaactaacgtccatcaagccaaatcaacgcaggataggtcttattatcgaaaaggattagtctctactaaagccagtcgcacccgttcttgcgatattcttgatgccataaggctgaatcacacgcaggagggcgtcaatcttatctccatcacctgtcatttgaatggtaatggagtgaggtgctacatcgacaacatttgctctaaagggttggataatcgctaaaatttctgctcgttttgttggcggagctgagattttaacaagaatcacctcacgctctaagtggggaatgtccgtcaaatcacggacacggaccacatcaatcaagcggtttagctgtttgatgatttgttcgacctcatcgtgactgaccacgtctacaatcaccgtcacacgtgagatgccatctacttctgttgggccgacggagatggactcaatattgatttggcgacgagataggacacctgtaaaacgattcagaacaccagatgaatttcgcaatttagctgttaacattctacgcattgaacttcacccccaacatttctgcattgctcttacctgctggcaccatcggttgaacatgttcacgattagaaatatgaacctctatgagcattggtttatcttctaagataactttcatatcttcacttagagtcgctggattgtcaaaactataatgactaattccgtaggcctctgccaacaattggaaattcggttcatcgtcaaagacagattggctacgacgcttttcatagaaggattcctgccattgacgaaccattccaagagagtggttattgatcaacacaaccttaatcggtacaccatagccattcaaaatagccaattcttggttggtcatttggaagccgccatcaccaacaaagatgattacttctttatctggattggctaatttggcgccgatagctgcaggaataccaaagcccatggttcccatgccaccagatgttacaagttggcgtgcatgtctgtaggggtagaattgagcggcccacatttgatgctgaccaacgtctgttacgacaatggcatccccttgcgtcaactgaccaattaattcaattgccgcctgtggcttaataaccttttcatcttcatcataccaaaatggtgcccgacgtttgttttccaatacttgtgccgtccaatcagcatagcctgtttcgactgtttctaaagcaagcagagctttcaaggttgccttagcgtcgcccactaccggaatagccgttttgacaactttaccaatttctgcgggatcaatatcaatatgtgctaccgtcgcatttggcgcataggttgttggatttcctgttaggcggtcatcgaatcgcgctccaatattgataatgtaatcagcctgatccatagccatattggcagcgtatgaaccgtgcataccacccatagccaaggataattcatgctcaatgggcattgcacctaatccaaggagggttgaaactactggaatacggtagcgctctgcaaaggcaactaattctttattggcatctgcataattgacaccaccaccagccaatataactggtttttgagcttggctaagctgtttcaaaattttcttaacctgcaaaccatttggttcaatcgttggctgataacttggtaggtgtagagttgggtcatgataaaaatcaacaactctttcttggatatcttttggaacatcaataacaacgggacctggtctccctgttgtcgcaatatggagtgcttctgtgatgactctaggaatatctgccgtatcccgaatttggtaattgtacttggtaatcggcattgtcatccccaagacatctgcttcctgaaaagcatctttaccgataccacgtgttgcgacttgaccagtaaaaactaaaagaggaacactatcacccattgcgtccgcaatcccagtaatggcattggtagcacctggtccagaggttacaatggctacgcccacctttcctgatgatttagcgtatccttcggcctcgtggaccgctccttgttcatgacgagccaaaatatgctggattccctcatattgatagatagcatcatatagaggcaaaactgccccaccaggataaccaaaaacaaggtctactcctagctgatgcagagtgtccaaaatgagataggaccccgaacgtggttggtctagttgaatttcttgcacgaatattcctcctctctgcaaatttgttatctactataatatcacaaggaagtagaatgtcaagaaattttctgaaaattcctacatttgttcgttttcttaactatttcctaacatttcttaagcaaaacttaagcaaatcccttgactggcttggtttcagcttgctttcagaaaacatcagtatagtagttccactaaaaaaattaaatgaggtttaggatatgtattatgtagtgataccggcttaccagccagatgaaaaattaatccaactattaaaaataatgaaaaacaggctaaattgtcaggtcatcgttgtggatgatggtagtactggcgcatccaaaaatattcttgaaatcgccaaaacctatgccattgttctccaccatgatgtcaataaaggaaaaggccaagccttacgaacagcctttagtttcatccaagatttgagaaagcctggtgtcgctgttaccgctgattcagatggtcaacacgctgtgaatgatatagaccgtgtcgcacgcgcagccatgaatctaccaagccgcctcatccttggtgttcgtcaatttactaaagacatcccgctccgtagccgatttggtaacaaactaaccagagtattgtttagattgcaaactggtgtcaatgtgtccgatacccaaacaggcttgcgtggattccatactgacttaattccattcatgttagatattgaaggcgaccactacgagtacaagatgaacatgttaactcaggcaagtcaacgctataaaattacggaagttccaattcaaactatttatatcgatgataatgccagttcgcattttcgtcccataaaagatggactgctcatttacaagaatctcttcaaatttgccctggcatcttttggtggatttctagttgactacggaatatatgcacttgccttattgctactcactagcttaccaactgctctacgcttattggtcgcaaacacgattgctcgcatttgtagcgctacctgtaattttgcacttaataagaaattagtctttaacaatgaagagagcatcgcacgaacaggcgtaggctactttacactagcccttgtcctcttcctttgcgatacagccctcctatatctcttccaccaaattctaggactcaacctctacattgtcaaacttgcagttggtatcttccttttcctagcctcttggttcattcagaaaaatatcatctttaaagaaaggaaatcattttcccatgaaattgcttaaaaaaccctttgcctacgcatccatcttcggaatgcttttgacaggaggttttacttactccatgttaaaaaccttcgtgctttccgaggctatcacaacggttgctgcaagtaatgctacttctacgagcgagcagaatacaactacagcttcgtcttccactactgccacaacagcaacgaatgtctctacaacggatactagttacactgatgacaatatccaaatcaacttagagaccatcactaccaacaacacaactgtttacgtcgcagatattcaagtcagctctccagagtatttaaagacagctctagcccaaaatacctatggcacgaacgtaacagctaaaacttctgaaactgcggcagcaaacaatgccattctagcggttaatggtgactactatggagccaattcaactggttatgttattaagaatggggttctgtatcgagacaccgttcgggacaatgcagcttatggcgacttggccatctacgcagacggctcatttgaggtcatttatgaaaatgagattaccgcccaagaattgattgacaagggcgttgtcaacctcttagcatttggtccatcattggtcgaaaacggcgaaattgtcgttgatacatcaacagaagtcggacgtgcaatgtcatccaaccctcgttctgctatcgggattatcgatgaaaatcattatatcatcgtcgtagcagacggacgtacgtctgaaagccaaggactctctctatatcaattggccgaagttatgaaacaatatggtgctcaaactgcctacaaccttgatggcggtggttcatccactctttattttaacggtcaagttattaacaacccaacaacaaatggaaatactatctcagaaagggcggtgagtgacattgtctacatcggttactaattcaactacaagagtttcaagaacgtttatctcctacttagcaataacagctttcctgtttattttcagtcgaatctatgaaagtctcagctatggcgaagtctctgtctttatgcattatatgttctgtgtaccattaataggcggagctgtgctactcggtttgctgcaacttatacctactctttcacgtctctcttataatttgtggaattctggcgttgcaactattacagctggttgtcttctccgaggcattatcaacctatctggacgttcaactaccttagatcaaccttattggtacatcggcgcagccttcctagttctatcgttagtcggtcttttcatcaatccatccgcaaataatcatcgaaaaacgacctcttaatctacaaataaattataagggcacttaacattcttaggtgccttttactgtagaataaattgttgaaaaattcggaaatttccaattgtttatcaaatcttttatcgtttctttcatatctatgatataatgggtaaaataagatagggagaagaaaattatgaccgatacaaacaaacttaaagactttcgacatcgtagctctgtttacgattcgatggtcaaatcgcccaaccgtgctatgttgcgtgccacaggtatgaccgatgatagctttgaaaagcctattgttggggttatttcgacatgggctgaaaacacaccctgtaacatccaccttcatgactttggaaaattagccaaagaaggtgtcaaggaagcaggtgcctggcctgtccaatacggtaccatcaccgttgcagacggaatcgctatgggaactcctggcatgcgtttctccttgacttcacgtgatatcattgcagattctattgaggcagccatgggagggcacaacgtggatgcctttgtcgcaatcggtggctgtgataaaaacatgcctggttccatgattgccatcgccaatatggacattcctgccgtatttgcctacggtggaaccatcgcaccaggaaacctcaatggcaaagatattgacttggtttctgtcttcgaaggaatcggaaaatggaacaacggtgacttgactgctgaagaggttcgtcaaatcgagtgtaatgcttgccctggacctggtggttgcggtggtatgtacactgccaataccatggctactgccattgaggtaatgggcatgtctattcctggctcttcttctcaccctgctgaatctcctgagaagaaggctgatattgaagaagctggtcgtgctgttgtacgcatgctagaacttggcatcaaaccatctgacattatgacgcgtgaagcctttgaagatgccattacagtcacaatggctctgggcggctcaaccaacgctactctgcacttgctggccattgcccatgctgccaacgttgatttgaccttggaagatttcaacgatttccaagagcgtgtgcctcatttggccgacttaaaaccatctggtaaatatgttttccaagacctctataatgtcggcggtgtccctgcggttatgaaatacttgctcaaaaacggcttccttcatggcgaccgcatcacatgtacaggtaaaaccgttgctgaaaacctaaagaattttgcagacttgactccaggtcaagatgtcatcatgccacttgaaaatccaaaacgagcggatggacctctgattatcttgaaaggtaaccttgctcctgaaggtgccgttgccaaggtttctggtgtgaaagtccgcaaccatacaggtccagccaaggtctttgattctgaagaagaagctatcgaagcagtcttgactgacgaaatcgtagatggcgatgtagtcgttgtccgctatgttggaccaaaaggcggtcctggtatgcctgaaatgctgtccctttcttctatgattgtcggaaaaggccaaggtgacaaggtagcccttctaacagacggtcgtttctctggtggtacctatggactggttgtgggacacatcgcacctgaagctcaggatggtgggccaattgcctacctccgtactggtgatttggtgacggttgatcaagataccaaagaaatcaccatgcacgtttctgaccaagaaatcgaagaacgcaagaaaacaactgttattccaccactctactctcgtggcgttctcggaaaatacgcccacactgtatcctctgcctctaaaggagccgttaccgacttctggagaccagaacgtacggggaaaaaataaggaactcaacgaccctgtcctcgcggtagggttttccaaaaggagaaaaaatgaaactaaacgtcgaactctcccgctttcgtgttaaagaaggcaaaaccgttcaagtagatgaatggatggcctttctcaacgagcacatggaagacacccttctcactcttgaaggagagaaaatgtatgtcgaaaccatcttccgtgaggtattggacggacgcgaatacctctattggtactctgtccaagccgaaggggggattgaagtcgaagattcagaatcctacatcgacaaaaaacatttagaatactgggaagaatgcattgatccaagctatggtatggtcgatctggatcctcaagtccttatgattcccaaacccatttatgaaacgatggaagaattagacagacaatacgatgacacgtttaaaaaagagctgcagtaaaataaaactgcaactcttttatttagggcttatccccagagtaattcgacctaagcgactaattcttgtcattttccaagcaggagaccaaacaatctcgacctgagcatcttctattccgtcaatagtcttcaaagctgctactaactctccaggcatcgtatctgcacatgagcaacctgcatcagtaaaggtcataactactttacaaaacccggtttcatctagatgaatttcatagacaagtcctaaattgtatatatccaactcaatctcggggtcgtgaatggattccaatacctccaccaattgatctgacaaaataagggctcgctcattgatctgaatatcttctctcatttatccaaacactcctaaaacatttataaaaagtattgtatcataattatttgaaatatacttgtcttaccaaatgttttcaactagttttcaaagtgcacgaacctctgaattctcaccttgaccaatagaaaagatatacttatgaccttgagtcaagctatgatagaagccatgaccagcataaatctgaaatacttgcattgtatcactagactcatctttatagatatgttgataataaggattatccgcaaaaactgtctttagatagtcgttctccacaggtctagcagccccttctacacacacgcactacctggataaggtacccttcctcagaaatagccgtcatcgcaactctttgatcccccatcaattgatcatagaaatgcgtttctgggcttgtcataaagaaaatcccttcttcgtttgctgcagtgatatgagcatgacgagcatgtggatttccatactcatccaaagtagcaaaaaccccaaccttcatatcttccaaaatatgcataatatcttttagttccatggtatcaccccttgaaaacacctattttctaaagtatatcaaaaacaagcgaaaatgttaagtggaatattgatagaaatagtgaaagtgtttcatgaacaactccctactgacggaaccatttaagaaggtagctatgtttgcttcattttcaaccttcaaaggttcctgaacccttttgatttccaattggtatggatttgactctgaaccgattatgacatcaatcaaaatccgttgtaactataaaaactacctaattataaaaaagcgactcttgagtgctttgaaacgttgatatattgcggtatattaacgtttactaaactggcttgctttacgtgctttcttaagacctggtttcttacgttcaaccatacgagcgtcacgtgtaagaagacctgcgcgtttcaatgaatcgcggaagtctgggtctacttgaagcaatgcacgcgcgataccgtgacggatcgcacctgattgaccaccgtaaccaccaccgttcacgttaacgaaaacgtcgtatgaaccttgtgttgaagttactgcgaatggttggttgataaccaaacgaaggtcagcatgtgggatgtactcttctacatcttttttgtttactgtgattttaccagtacctgggaccaaacgtacgcgtgcaaccgcgtttttacgacgaccagtacctgtgtattgtgcttgtgccatttagattacgtcctttcccttagataagacctgaaatatcaagtacttctggttgttgtgcagcgtgagtgtgctcagcacctacaaacactttcaacttcatgccttgtgcacgaccaagtgtgttgtgtggaagcatacctttaactgatttctcaatcaaacgaacagcgtttttagaacgcaattcaccagctgagattgatttcaagccacctgggtggtttgagtgagtgtagtagatcttatcagttgcttttttaccagtcaatttcactttctcagcgttgattacgataacgaagtcaccagtatcagtgtgaggtgtgaaagttggtttgtttttaccacgaagaacgctagcaactactgctgaaaggcgtccaagaggtacatcagtagcgtctactacataccatttacgttcaacttggcctggtttagccataaatgttgttttgttcatgatttctcctatacgaatcgtttttgtttactgggcggatgttccggtccgcgggtatttggaaggttccggggcctttcaaatggggtaaacaataccatctaccattttatcaaatctactagtgtccgtcaagctattttactttactttttttattttttgaaagatagcagagctgctgagaatgaaagccttatccattttaaatttcttactgccctagttgtccaggcaagaccagcttctccttataaggaaaggttttatcaaattcttccaagaccaattcatccaccgtatagaccagaggacctgtaaaacaccagtttcagccatccaaggcttctggttggaacaacttgacaatgagcattatcgtacctccttttgattaccctattctacataagtcgtcatcacacaaaaagggacacatctttacaagaaatatcccttagaatctaggctctcattgctgtaccaattgataaaatagctaagactcctgtccctgtatgagtggcaatcacaggccctaattctgtcaatagaacatcagaaatacggtcgtcttccaataaactagatttgacgccctctgccgcctcaatatcacctgtataggccaccatgaccgtagaatgatccaagttgtccaaggtcaagttcagcatttccttaattccttttttacgaccacggattttggcaatggcttctaacttcccttccgcattgagtgcaaggagaggtttgatattgaccaatccaccaatgagggctgccgctttagacaagcgtccacctcgcaccaaatgattaaggtcatcgaccaagaggtaggttcgtaagcgcggcaccaaatcttctacgattgccttggtttctgccagagtcttacctgcagcacgtgcctcaacggctttcatgactaagtagccttctccaatggtcgctgcctttgtatcaacgatggtgatgactgcttctggatattggtccataaccatatctcgtgcaataactgcactctggtaggtccctgaaagagctgctgagaaagcgagataaagcacctcatgatcttccttggctgccgcttcaaaaacttcttcaaactgaccaacattgacctgactggtcgtgggttggctgccagaagccattttctccagtaaatctgcagaggtcaagcggttttcaccgactgtttcataggttgcgccgtctaggttaatggtcaaaccaagcacggtcacatcgttttcttggacccagctgattggcaaatccgatgtcgaatcggttacgattgtaaatgtcactctttcatttcctccatcatttcttttaaggcttgaaaattcccatctgaccagggattgagccgtggggtgtagagttctacctggtccacaaacttgtccaagtcctttttgatgaccttggttctctcctctaactcacgcgccgaaacccgtaaggccccttgtgaaaagaccacccattgttcgttgaggtcgctggttgcgacggaaacctgcttgcgacggtcactattgagctgggcactgagtcgttcgatataactatctgccgtctcttcctcctctgtaaaaatgaccgataccttgaattcgtcatactgctggcgaagacctggcacatggtgggcatcaaagacacaaatcacctcaatctgttcaaaggctgcgtagtgagacaaggtgcgaagcaaggtcgttctggccgcatccaagtctccctttttaaaatcttgcttggtggcctgccaaaaggcaatcatgttgtagccatctacaatgagaactttttctttcatttagattttcttccgaaatacttcgtacatcagcacagctgctgctacgctggcgttgagagattggacatggcccttcataggaatggtaatcatctcatccacctgctttttgatattgctggagatgcccttgccttcgttgccaataataagagctagtttgccagctgtattccacttgtggcttggagttccgttcatatccgtgccaaatacccagaaaccagcctccttgagcttatcgagagtttggctaagattggtcactcgggcgattgggacatgggccaccgcacctgttgaggtctttgccacaacgggcgtcacgccaactgctcggtgcttgggaatgatgatgccagctacctgagtggcatctgcggtccgcaaaatcgagccgaagttgtgggggtctgtcagaccgtccaagatgagaatgaggggattgtcttcctgctctgctttttccagaatcaccgacaggtccgcataggcgaactcagagacccgcaggacaaagccttggtgaacggcaccttctgtcatgtcagacagggtcttcttgggcgtccaagaaatcgacaccttcttctctgccgccagggccttgattttttcaacattttttccgcgcaaatcatcctggatgtagagcttgttgccggtgttagcctccaaactctccaccacagcatgtacgccatatacgatatcattctgttccatggttttattatagcatatttttgaaaaggaaaaagccgagaatttctcagctttcttagttcacactgttttccagataataatgttgggcaacataccagttgacacccccttgttccggatctgtatcatactcactagcttccaactccccacgactattgatccgataactccaatttcgtggctcaaaattagggtctgatggtacagttacatctgcataaactaaaccatcctcagccatacgaacacttatgacaacctggtcttttcgatacttttcaatcatgacgctacggctaaataaatcatccataacccaagcttttacctgatctgtcgttaagtttttggtatcaacctgcggtacaggattatgcaaatctgtcaacgaaatccaaccctgtcctgactttaatctgccccaactatgtccttccttttgagtcgtctcaactatcgtgtacgttccaggttctatattggtcacaacttctccagataaactaggttcctgacgaataaccagtccttgttttttaatatccacagtaaacaattgaacggcgctacctacctgagactggctagaagcttgcgaacttccagcagtcttactagtggctacctcactagttgaactatcctcaactacggtagtatcctttgcatctacatttttagcaataattaagttaaccgcacttccccgctttaccttcttcccactacttggagaagatacactaaccatcccaggctgaactgactgtccaccaacttctgttattgtaccaacttttaacccctcttcatacagtaaatccttagcttcagatagctcaataccatataattcaggaactgtaacttgagaaatatcttggtatacaaaatataagccagccattcctaacacagccacaacacttgaaatgattagccatatctttcgtctttttgcgtctgccaaacgtttctcagcttgctctctttgataattctcataatcttcctcagcttcgctaagcatttgctggatgacaaatcgttgactctcatccgtaacctgtgctaagtgcaatcgtaattgaaaaattctatccttaaactctttttcaatttgacgctcatgctctttttgcaaaatgttattttgtttttgaagtgctattgcttgagagttcatagcagaggtttgagcatccattttttgcttcaattcatcatgtctctgccgctcttcaaaatctcgcatccattgatccataataatcatctcctcataaaatattggttattatctacaaataaaatctattttattttagtatagcataacaccttaatttgtcaatcctcattttcaccccgtttcaatctaacttttgacaaatagtaaagcctatgatattctaacatctactatttgtccgtacaaacggaatcgaaaaaggagattttatgacacttatttttggaattgtggcggggctgattgcctttgctattggtggtttgtggtatggtttgattttccgcgatgcttggatcaaggcttcaggcattgacatggctaaggtagaagcagatcgtcaggctggcaaaaatggacagaaggaaatggtgatttcccttgtcattgaagtactgactgctgttgtggttattttcttcatcaagaccctcggtgtttcaccacttcatgcagctggtggcatgggcgtaattgcggtccttgcttcattgaaaaactacgtctttgagcaacgtcctatcaacctcatcctcatcaacgaaagctacaaactagtctgctacctagtagtcggtattctagctctatttgcataagtaattccctcctatccttaggaggtttttattttatgatacaatagaaatagactaaaaccaaaggagccctcatgtccctctccctccgcaccatcaaactgatatttgccaccgttctggctatttacctagcgaccgtactgggcctgtcttatacgacagcggcaggcatcatcgccattctcagcgtcctcgacacccgcaagtccagcttcaaaatggcccgcaaccgcctcttttccaccctcctggccctgaccatagcagtcctgaccttcgccctctttggctttggcatctggaccctgggcatctacctagcactctacgtccctctggcctaccgtttcaactgggaggctggcatcgccccatcgaccgtcctcgtcacccatctcttgctagagcaagatatttcgctgatttttttgggaaatgagctgacgctttttctgattggggcaggactggcactcttgttcaacctctatatgccctcgcaagaaaagaaaatccaggcctaccatgaccaagtcgaagacctactcaagcagattctcctccgctttgaagcctttctgctcaacggcgacggacgaaacgaggcagaattgattacgcagctggataagaccttggatgaggccctgaaggtcgtctacctagaccgccacaaccagctcttccagcagaccaactaccaggtccattactttgaaatgcgggcagcacaaaacaaaatcttgcgaaccatggcaggaaatatcaacaagtgtttactggaaggcagagaaaatgtcatcctgtccagcctcttcgagcgagcagcccagcaactgagccgagacaactccgccaaggaactgctcctagacatcgaactattccatgccaccttccgcgagcgacctctgccacaaacaagggaagaatttgaaacccgtgctaccctctttcaactcctgcatgatatggaagcttttattcgcctcaaggttgatttttatgaagtctataaagaccaagaaccgtcaatttaagccgacggttcttctacttttccatgaaattcatctgatacttggttgtgcaaatgcacgaaagataggcccatcatgactgcattccctgcaactgcaatcataaattcttccttggaagatacctttcctagccaaatggagaggattaaaatgagattgtaaagaaggatagaaagagctgccaaacgaatttttttcagtagtgtcttcataggaacctcctgtaagtgttgggagtgggacagaactcgaccatccatagaagagttcgttttcccacccccgcacagttgattaggtcagatttggagtgtaaaacacgaacaaatctgccaatcaaccactgcgctgagatgttgacacgaactctgagaagtggaactgggctttttgcccagcctctttaataaaaataacaagtatttatgcgttcttaaccccaaaaaaccgccagattttcatctagcggtcaggtgttttatgaacgattttagaaaggttagacaatcgccttgcttgtttcatcatcaaagaaatgagctttgttgaggttgaaggtcaagcgaactttgtctcctgggttgtggtagtcgcgtgcatcaacgcgagatacaaactctgtgctacctactttagagtagagcatggtttctgcaccgagaagctccgatacaaccacttctgcttctacgatggaagatggataagtgtccaattccaactgagaagccttgatgtcttctggacggataccgagggtaaatgatttgccattatagcctttttcttccaagtgtttgcgacgtccttctggaagctccaccttgaaaccatctccaacaagaacgccatcttgaagcgtaactgtgaagaagttcatagctgggctaccgatgaagctagcaacaaacttgttaacagggcggttgtagagctcttctgggctaccgatttgctcgatacgaccgattgtacctgtgcctgctgggtttttagttgcagacatgataacgatacggtctgccaaggtcatagcttctgtttggtcgtgggttacatagatggttgtcgcaccgatacggcggtggattttagcaatctctgtacgcatggatacacgcagttttgcatccaagtttgacaaaggttcatccatcaagaatacttttgcatcacgaacgatggcacgacccatggcaacacgttggcgttgtccacctgaaaggtcagctggtttacgttctaagaattctgtcaaaccaagaatttgagcagcttcttctacacgttttttgatttcatccttgctgtatttacgcaatttcaaaccaaaggccatgttgtcaaatacagtcatgtgtgggtagagggcatagttctggaataccatggcaatgtcgcggtcttttggagccacatcattcatgagaacgccgtcgatgtatgcttccccttctgtgatatcttccaaaccagcaatcatacgaagagttgttgatttaccacatcctgaaggacctacaaatacgataaactccttgtccttgatgtccaagttaaagtcttcaacagagtagtgctcgctgtttggatattttttatagatattttttaaattcaattgaaccatgttcaatcctcgctttctttgatagttttattgtaaatgaaaacgctttatttttctaggtcaaggtgaacaaaaagaacacaatcttttgtacaagttgcacaaaagactgtgttactgaaatagtttactttccaaaaattcaatgagccctttgggattttcagtagaaaagggacgaagcgatgggtggcattctcaaaggctacaacgcttttctcatcattagctcctattagatacttaaatccatgataaccatgtagcaaactgccaaatccgtcaattccttgagctgtaatcccgtccaatcaaaccatttgtccaagcgatactgtagcgtatttcgatggatatagagagactgggctgccttggttatgaccgcaccttcttgccaaagagctacaatttccttttctagctgctggtgggcaatcaaactagcaagtccttctctcaaaacggggtggagttgacctgcccaaagatagagctgaccgaaggtaagcaaccgtgattgatggtggctgcttcgccaatggtgaaaaagggattgttcagcttcgattaattgcggccaagagtgtaccaatttggctggccagatttgccctaaaaacaatgtaattctcagaccaaaatcgaactccatggtagcaagggtgtcacgcagtatttctttgacgtcaaaaagaggtgcctgatgtagaatgaacaggtaatcttgtccattgcctgtatagtagccttggagattggggaggagtttggccatcatatcaagccaggctacctttccatcttcatcggatacgtggcctacatgagcatgaataacctgtagtttttccaaggtttgtggaagaggacctcccccttggaaatagcgtccccaaggatgaccttgttctgcgctcgagtcattcatcagcaagtcaatcagttcgatttctcgatctgtcaaatccttgcgatcgacggaaaaccaggtttgattagccagaggcaactggatacttgctccgttttctgtcttttcaaatacaagccttccttttggaaataggtgctgcaattcttcccttttgctcatctcgcctccatctcattctgtctgtaattgaccgattttctgtcggtaatttttgggagattccccacaaatgcgtttaaaaatcttatagaagtaaccgacatttgtatatccaacttgaaaacaaatttcttcgattcccaactgactgttcaagagaagctgttgcgctaccttgattcgctgatgattgagcaattctgcaaaagtatgcccggtctcttttttgataagttgacctaggtaaaccgtatttaggtagagatgagcactcatatctttcaaagacagttcctctgcaaagcgttcacgaacaatcgtaacgacttcctgtatatgtggactgtaagtggaactctcggaaatttttttcagataatgacaaaaatactccattagttgatgtaaatctcgactcgcttctacctttacatagaaatcttccaagcgctgatggtcttcttcattaaaatagtaaaacacatccgacatcatctgattaaaaaattgttttgttaggtagactgccggagtggtttcccgtaatttatcagccaaatgtggtaaaacatcaacgatttttgccaatcttcctgcacgtagaagcggttccatatctttatagagttcagtggtagtagccgttagatcttctgatagttgcttataaaataagcgcctctctaccttgtcaatcaactgccgtatggtcatcgtcggggtaacttcttctgtatatagactaccctctggtcgactttctgtcaactgaaaatagtagacttgatgtaaaatatttttttcacgacagtagcccattgggtttggagtctctctagcggcaaaccatgttttctgggagtgacttaagaactcactcgctgtcagggttcctgccaagaagcccttggtgtattccctatctgtctctttcttcaaggttggtagctgttggagcagcttagccagttcttgtttattgatgggcttaaggagataatccattgcccctagggagatagctttacgggcatattcgaattcttgaaaaccagacatgatgataatatgggtatcaggcgattgttctttcattcgtcgaaccatttctaggcctgtcatatctggcatgctgacatcggttaggacaaggtccacagtatgctgtgaaaaataatccagcgcttcttcggcattctctgccgtataaacaatctcgacattgtattcatgataagggagaagatgcttcatcccttccaaaatcatatattcgtcatcaactactaacatcttatgcatcatgctcatctcctcgggggaagacaccttcaaataagattgaatatgtcaccccttccccttctttagaatctaattctatctggtaacggtctccaaaatagagaagtaaccgctcgtgaacgtttcgtaatccgattgattgtgaccgattttcttgcgacagttctcgacttgccaagaggtgtttgtaggcttccagagtttctgcgttcattcccttaccattatctctgatgagaatttccatatcctgtccatgcttgagagctttgacactaagcgcattgtcttttcgtttgaggtctactccatggacaaaataattttctaccagaggctggattacaaaacgaggaatttcaaccctttcgcacccaggatccatttgataggcataggcaatggaacggggatagcggatttgacaaatgtagctatgtttttcgcaaaatgaaagttcttctgccaccgttgtcatttttgcctgtgtcacactactgcgaagcaagcttgaaaattcataaatcatatcccctagctcatccatctgcttgctgactgcatacatacggaaaaattccaaggtattgtagagaaaatgggggttaatctgggcttgtaaggctcgcatattggcatctttctgagctaactgcaagcgatagatgtcttgaatactctggtccatagcatccagcatctgattgatttctgatgaaataagatacatttcctgctctttattgtccgtctgtagacgaagatgcctgtcttcgccacgaatctgttgcatggtatcaacaatgtccagtacttgaacttcatatcgtttaaacacccttctcaggaccagtagtaaaagagcaacgagacaactacttcctagaaaaatgattccgactaggctgccaactttttcaatagcatactgctggtcaactccaactgcaatttgcaaatccccactcattcgataggagagcggaggtgaggcaacatctggtcgcagactataaaattcccgatccagagaatcttgaactctaacggtcatggggagatccgtcttacgttgaatatattgttcgagcaaatccgcatcgatggtgacatagatggtcgcaataccttctgttgtcgatggagaaaataaggtcatcgaaatactatgttgcggagccttgtaattttcggccgtgacctttttaccagactttaagtcagaggtagaaacaaagacagtatttgcatccatcggagcaatatcgactccttctacgaagggataatagagatagagagtgcgaacagaatcctgcaaggaaatccgtttgaccatcaggtgtgggtgactcagtaaccagacctggtactgagaaggagataattgaaaatagtgataaaggctgtctagacgatccctgtccgtaatgtagtctgctagataattcccaacccgtccttgataataatccaactcctcttttagaccatctgctacttcctgttgaatgcggatgcgattggtatcatactgataccagctgatgtaggaaagaatactggcaaagaaaataacaatcccaatcactaataaagaataacttttcaaaagagtatgaattaaaacttttttcataagtaatccttgtcaactttcttataaactggatcaaaggcatcatagagaaacaagagccataggaccggtaggaagaagaataaaatcaagggaagcttgaatagcaagaccccacagacgagactgcctaacaaaaatttgaccagggctttccaatcaagaaaaagcgagacagccgccaactgtaagcctgtttttagactaaattcaaaatgtacttgaagttttaaaaagagagcatagagtgcaaaaatatagaaaagcccaaaagcatttgtaataagaactgctggcatccaccaggtctggggcaattgaatcaagagccaaatgccgctaaataaaagaccaatcaataagaagacaagaccaaggccaaggttaagccgaataaaatgctctttaaaatagccaaacgcctctcgaaaattatacttagatgcatccatatgatagttatcgtagaggtaaactatcgttccatttgctggtgaaatgcccagcactacgcctcctagcaatagaagaaccaaatagatggcactcaatttcatgaggaagaacagaagagtaaaaagcctgtctaaccaccctaacattgtatattcctccttttttatctattttatcaaaaaatcggtgcttttctaccatttgtcaagttcatcaaggtatttgacgaaaaatattttgtgtctcgtcatccaaataaggaaattgttttattttggactaaagttacgtgtaaaaagtgcatacaaaaccaacaccttatgttgaaattttttgataaggtgttacaatgatagagcataaacagttttaccgattttgggttgaagcgtaatcgtaaaatttgttatgcataatgaggtaatacattgtccgaatgagacgatgtatggaggcaatcgtgtgcagcttcgttgaagtcgtttgcgattgtctttttcgtttcttataaaagtctgcgatatggcaaggattggtatgattggctgaagcgatattgtggatacacttgaacagaatctttctagcgtagggattaccacgcttggtaatgtgttccttagcgaggaagttaccagattcatagtgtctcaggtcaataccgataaaggcattgatttgattggcagactgaaaacggcgaatatctcccagttcaccaataatacttgttgcagtagtctcagctattccaggaatagagagcagaatgtcatattcaggtaatggctgagctagttccaccatttcgtctaagactgcctgtctctgttcagaaagtctaagcaattcttttgtatagtaacggacctcttccagtattggagaggttttcttgacggcacaataagattgattagctagtgctataagcttctcggctaagtaagccacacgcttgtcagaaatccgttttgaagtggacagacggatgctctttgagagttcatcattgcttaactcaagtacgcagtccttacaaggaaaagctataactaagttccagtattgttcgccagatggtgtcgataagatattttccaattcagggaaagtgacctgtaagaccttgtgcaggcggtttttagctcgaacaatatcctcggtcagattctgatagaaacggctgagatcccgcaagttttggtagacttcttcttggacataagtgggtttacgattcagcacaaattgagattgagccagtttttcagcgtcaatttgatctgttttccgcacacgcaagctatccagttgcttcttagcttctaagggattaagccgtgtataagcatagccattatcatctagaaaagtttggagacggcgagaatagacacctgttgcttcaaagatgatttctggcttatggacggttctcaaatcgccaagtagccgagcaaagccgatggcgtcattggatatggtatagccatgaactttctcaccattgactagaatggccacttctgaacttgccttactcacatcaatcccaaaaactactcgcatgatattacctctttgtcttgaatgattccttgttttagcgatgtcattttcaatactcgacgtctggcgtcccacatactttgataacattctttctaaaacaggtgtcttgccagtttttgttgcgacgtctagcgtcaaaagcaccctcgacttaacaagacacctctactttatcataaagaaaaagtagtgagtactttctcccgtcggagatttcctcactactaatcttagtatgtttttgtatatattaacataaaataaatacaaaagaggctgagcaaaaagcccagcgccacttcttagagttcgtgtcgacatctcatcgcagtggttgattggcagatttgttcgtgttttacactccaaatccgacctatacgactgatgcgaacagaattcgcttcatctccaacctcaaactgtctcccagacagtttgagctgtgcgggggtgggagtgaaacagtatggggatagactgtttcagctcaacaacttaaaacgaaaaattgttgacgaactttttttagaccagtcgagttctttcccactccctcttttcacacttcatcacctgtatcgtattatttatttgctaaaaactcatcgtattgtttttgcatttcttcttttacttttttgtaggattcttctgcttccaattttttcagcatttctggaacagcaacatcaggatccacagtaccagtattgatacttgctgcatattggctcatgatattttggatacttgtaatttcagtcttaactgcatcagcattgaagttgaagccaagaagtggagactcttctgcacctgccagcaattcttctgcttttttcacatcttcatctgttaccttgtcagtgatgtagagaatttggctgttacctgtgttccaagctgacatacgagtatcgcctttgtaaccatccaacaacttgatacgattttcagcacttgggtctttttcccagttgactccctctggaccaaataccaagccgttcagcaattctggatttgtattgataagggtcaatacttccatagctttttctttgttcttagatgtttttgaaatgacaaagtttgctacttgggtagatccgcttgtcttataggcagatgtgattggtttagaagtaatcttatagcctgcaactgttgaaaggaggctatcgccaaagtcagctggtccttgtgtttcttcacgaacgaaccagtttgctacatcaagtgagaaggttgcgtcagtagtcgctgcatctgccataatgtagccagccttatagtatttgtgaatggtacgaaggttatccatgtgacggtccacttcaaatgggtttaccacttttgtagtgtcgcctttcaagtcgatagcaaatggtaactcattcccagctggatattccaagccgtctgttgagggtttgctagattttacccaggcaaatggtgttacatctgcttctttttctttgatggttgccaacatgctttccacatcatcgtagctatctactttagaaatgtcaaaaccatacttatcaaccatgtcttggttgaaggaaagcatctgttgactagctacgttaccgatgacagggactgcgtagatttttccgtcgatggtatttcctttgatataggcagggtcaataatgtcatagagggccttgccttctttcttgtaaagttctgttaaatcagcataagctcctttttgcgcattgataatatagttgtctgcaaaggcaatatcatattcctcaccagatgaggtaataatggccattttatctttatagtccccccatgagatatacttgatgtctagatgggcccctgcttctttttcgataatcttattggcattttccaaaagaacatcgatgtttttcggtgcgtctccgatttgatacatgaggatgtttgtcaatccatcttctgttgtagtgctacttgatgcggtcttatttccagtcagactaccacaagcggcaagggcagctgcggacgcaagtgtcacgcaggagtaggcaaattttttccatgttttcatttggctgttcctttctatttttttagataatgaagtatggaatacgattgttaagatagagtgatgtctctactccttgactccgccaattgtcaaacctttgacaaagtaacgttggaagaaaggatagagacaggcaattggtagagtcgatacgaccacaatagccatacgtgttgcttctttgggaagggcccctgcaacttctgaggacatggccgctgctgcggcagcattttcagagagatattgaatgtttgcttgaattttcatcagcaggtattggagagggaagaggttatcgctctggatatagaggagagcgttgtaccagtcattccaaaaagcgagggctgtaaagagagcgattgttgcgatacctggtagggttagtggcaagcagatttggaagaaaatccgaaattcactggccccgtcaatcctggcagattcgataatagactcagaaatagtctttctaaagaaggacctcatcaccatgatattgaaaggagatagcagcataggtagaatcaaggctgccactgtatctttgagatttaaaaacgaggtcataacgatataggttggaatggtccctgcgctaaacagcatggtaaagagagccatcagggtaaaaaatcgtctgtatctgaaactgtttctcgaaatggcataggcgtaaagaacggtgaagaagacattcaggctcgtccctacaatggtcacaaagaaggtgataaagagggcttggagaatctgatcttttaattgaaagagatattcataacctgccaaactccattgctctggccagaaagaatagccgttgatagccaagcttgtctcatctgtcatagaaatgatgataacaaatatgaagggaagggtacaagatagggcaaatatccctagtaaacttgagaaaaatagatctgttttcttactaaatgaatgaatagaaacagaagtgatttgtttcttttttttcatactcccctcctagaataaggctgattccttatcaaagcgacgaacaatcaggttggtcactaccaccaagatacagccgacaacagactgatagagacctgccgcgatagccataccgatgtcccctgttcctgcaattccacgataaacgtaggtatcaaggacctgagtcacattgaagagaggacctgaatttttcggaatttgatagaaaaggccaaagtctgctcggaagatatttccgacagccagaatcgttaaaatagtcatcagaggcattaactgaggaagggtgacatagcggatgcgttgccatttggtcgctccatccacaatcgcagcttcatagtaggttgggtcaatgcccataatggttgcataataaataatactgttatagcccaaacctttccaaattcctaagaaaagcaagatgaagggccaataggttggtgtgctgtaccagttgatgggatccatccccattcctttgagaatattgtttatcaatcctttatctggactcaaaaatgcgtaaacgaagaaactgataatgacccaagaaaggaaataagggaacaaggttgtggtctgatagatctttaccagcttcttcgaccgcagctcactaaagataatggcaatacctactgcaaaaatcagtccgagtacgataaaaccaagattatataggatggtatttcttgtgatgatataggcatcggatgattgaaatagaaatttaaaattatccaatcctatccacttactttgtatgagactatcccaaaagccattacctgtatggcgatagtccttaaaagcaatcacattgccaaatactggaatatagaaaaatagaatgagccagatgactcctggcaataccattaggaaaaaaatggcattttgttttagattttttatgaggtctttcatcatagctcctttctattatgaacctttacattattagtttactcctgattgggccaactgtgaattgccacattataggcaaaattctacaaattataggtgtatataacaaccgatataccttctgtaaaaaacaaagaaaatctgggttgctaatcaaaatttgcataaaaaattgagccctttcgagctcgagaactactaggtcgtatagatggttgaagccgtcgcaataatctgccattggttggcagttgtcgcaataaatcccttgtcctgatggaagtcatcgtaagggagaattggcacttctagttcatctagtttaggtacttcattgttcagataggcttgcaaccgctggattgctcggcgaatgcgggcatccaatccccctaggcgaatgtccaccgtatccagaccaaacaccttcttctctaccatccattggtagctaagtgcctgatagaagctttccagatctattcttagttgctgcaaaccgtcaactttctctgccaagacctgacgatttccttcctgataggcctgacgaatacctactgaaatagccgccttggtcgctaaaacctgacacaacttagcctgagtatcaaagagataggcatagcccttggctcggcttccaatctctgccaatctaggcgctaattcctgataaaaggcattgtctttttcggcatcaatatgctcttgcagcaaggggcagagaatatcctgatacaaaatgtagcgactgggattgaaaccgtgatgacctggacctgggtgactaggtgtcttatttggcaaatccaattgcaggaagtcatctagggaaacttggtgtagttgatagaaatgctcagccagacagcccaaatttcctcggtactggagttctgcccaggcatgaagactcggcaagatcgaaaaggttgcgcattctccaccattatctccccaagcggtcaccgtcacttcttggacgccatactcttggcaggcagcatgtgcttttggtgcaatccgcatactgaaatcattatcaggagtaaaaccaatccacttccaggcaccacttgcaaaggcaatctgatctcccaactgctgatgactagctagtttttgaccatagctctcacgactagtctgatagtaatcccaataaatcaaggtcactctgtccttgagacgatccaaataagcctgaatttccgaatcaatttccaactgaccagtataatccttactcgctgtcaacaactggaagaacatatcgctccacatactacaatggaagccgtacttgtcagcaatatccaagacccgttccaagtgttggcacataatcagacttcgtttctgatagccgtgttgattgaggtattgacccagcccgaccaagtgagcctcatccataccgatgttaatggtccgtgttttcagatgggacaaagcctcaaacatcttatcaatcaaggcataggtcctctcatccccaatcaagagaatattatccacatctcgaatggcctgaatagatgaaatgttccatttgaggtaggcgatcagatgggccaaggtctggatacagggaataaattccataccgtaacggtggcactcctcctcaatagcctgcaattcttcttttgtataggcccctcggaaataaccaaaatagggttcatcacgtagttggtaggtatcttccatgtaaagctggaaatggctgtagcctatcaaggccaattgtctaatcaagattttactggcttcaaccgtcaggacagcatttcgagaacaatcttccataaaaccgagttgacgataggcaggtctttctagaatctgtatgtcggtctcaccctgagccaactgactagccaaaacaagcaagcctcgataaatcatgtgttctttaggcgcacggatacggtaagaacctgctgaaccttcaatccgcaaactctccttgccaccgacttcaagttctaactggcaatccaagccaagcgaggaacaaatctcttccaagaccccctccgactgccgtaacgaatggtttatctgtaacatcatcatttctccttattgtagggtcttcatataagcacccatgagattggcatcctgctggtagtggcaggcacgaatggcaggtagataaggaaattcttctggatattccttttgaatagcctctagttgctcctgaatagcttggataaagactggattctggctgatagagccacctatagccagcacttctggttccaggaaataggagatatttaaaatgccataggccagattgcgtgtcatttcttcaatggctaattgacatacctcatctccctgttctgctagctcaaaaatccgcttgccgttccaatcttccacagcttcctcatactgactagcaacctgtctgaccaaacttccagtagaagcaagttgggaccagttttttagaggtccctttccagtagcaatcagcatatagccaaattcgccaccgaaaccttgtttccctcggatgagttttctatccacaatcaaggcaccaccgatacccgtaccacagacgacacaggcaaaagtcgataactggtcatcaacagccaattcactcagaccgacacaattggcatcattttccaaataaacaggacagccatactgacttaatagctcataccaagatacaccatggatataaggaacggcactcagcccctggatgacacctgtttcaaggtctaccgctccaggtatactgagggaaatagcctccaagccgtctaccggctgaataacactgtccataagcgccaacaattccgctaaactagatggcgttttccattcctgcctatagtttatctgcttatctgaaccaatcagggccgcctttattcccgtaccaccaatgtcaaaacaggctactaccatgttctttctcctttccatgatgaccaacgacctctgttcggattgcctgtgacccaatcctagccggcaaatcctctagtggttcttctagcaaatcaaccccctcagtccactcgctccaacctgctaactgctcctgactcatattgtagtaacggagcagaatgcggtccgaagtctctgccaccttcaaagaagtcacgcataagcggtcctcttccagtgctggatggctcaaaaactgatgatcacacggcagatgcccactatggctagtcaactgtttagttagcaagtgtccttggaaggcctgcgctctttggaagctggcaaaaccttcctctactgggcaaatttcaaaggcatagtccaactgacattccctcaaacactgggcttctggtgttgggaagtagccccaatctcccagctctccagtcgcacgaagcaaggtaagagctatttttcccttgtctaggatttcatactcatgtaggcccttactcgaaacggtcatggcttgtcgaccatctgatagactaataaaactgcgatgacgctgaggattggacggattttcccaggctggatgtggctgatttggacgttcaacgacttcaaagatggaatccgccaagtggttctcagcttctattccaatatcaaagactgctcgcaagcgatggtccttgatttggttgtggaaatcggtctggatgcgaatttgggattggtggcggtagagtgtcagataggtggtaaggagcaggtctttcttttcctgactcctttgagatgttcgatgtttaaattctaccaggcgcttctgttcatcttccagacttgtttccatagctacaggcagctgcagacggtgcatgaccttggcaatgctgaccgcttctgtttggtagacaagaccgaagtactctatctgaccatagatcggttggtcattcttaggcgccatgaagatatattcattgcccaaatctccacaatcttcaaaccgtagccagtctttataggcttgacccgttctcttatcttctagcaagagctgaccatccatcacattgatacggtaataatcattctcgaactgttcacttaaactgctattcaccctagtgtcaccaatcggcttgacttgataggtctgccatgaaaatggtgcttgattttccactacaaagcggacacgaatctggcgggcaaaattggcagagcgaaaagcatcttttggtaaatcgtagcggaagttgacacctagatcttcaatggtagcttctacctcttggccttgactggtaaagaggcccaaggctggcagagaaatagctgccatggattgaaagtgttgttctaactgcccatctcggaaatcctcctgttcaacaagcaaatcaacctccactaactgggtttgtcggcaggctgtagtattgaaaaccgtaaatagtaagccgtctaattggctagaatccacctgcttttcccacctgtctagggagcgctggctcaagaaatgagcgacttgcttgaccttcttaaagcgggtttccatctcactatgcacctggtctacgctacaaccacagatgctatcatgaggggcattctgcaacaagagtttccaggcatagcgcaactcatctctgggcaccttatctcctgtcattaccaccaagggttctacaacttgttccaagagctgactggcttggtcattggcctgcttgagataaattctcgaagaagccgtatttgccaaggtgtaccagccatccgtttcctggctaatcaattctcccttgacacgactgaggtctactggtaactcttccttgacagctgcgatatattcttcaaagcttgaatgaacaaagtctatatctggatacagttttcgggccagtcgtaatgcttggctgagatttttctggacaggctggtggtcacagccattcatcagcagatagtgggaggttgaagcgtatttgcgaacatctgccaattttttctcccagaaaacacgtgcttcctcctcatcaactgggatttcattgccattgctgtaccagttagcaaataaaatgcccagaacctgactgccatctgccccctcccaaatcatctccgagaaagtggactggaattggtcatctcccagaacctgattatcaaagccaactggtttgaccccacgaccaaacaaggccacatctataccagcctgacgcagtagctgaggagcctgtcccatattgccgaaagtatctggataataaccaatcttcggagcccgtccccacttcttgctttccaaatgacccagaagggtatttcgcatattggcctcgctggtgatgaggtaatcatcctgcaagatgtaaaagggaccaataatcagccgaccgtcttgaatatatttcttcaataactctcgattctgcggacgaatttccagatagtcatctaggacaatggtctgtccatctagatgaaaactcctaaactcaggatctgtttcaaataagtcaaacaggtcatcaaatagctctactaagcgcatccgatgttcttccaaaggaagataccactccctatcccagtggctatgtgaaataatatgaaccgtttcttttcccattttattcctccggtcgtatatcataataatctaaaaccaattcgcaaaacatcatatttgcccaggagaaccactctctagagtaaagcgtcggatcatccacatggaaactctcgtgcatcagcccagtaccgccatcacaggctaccatggtatccagcaagcgcgctttttcttccttgtcatccgttgtcaatccttgaatagccaaggcaatcggccagatatagcgatagaaggtatgactggaaccaagacccgcagcatagtctccctcgtagtaatagggattttcttgacttaaaatagtccgacgggttgccaaatagatgggatcatctttctgacagtatcctagatagggagccgccagcaaactcgggacatttgggtcatccatgatagactgattgcccaatccgtccacttcataggcaaaaatagtttctcccgcctgattcttggtcagcccgaaggtccgaatcccctggtcaatttcctgcgccaaccgtctggcaccttcagccaaatctgagaattcctcacttgcaaactgctctgctatttctcctaaataacccaagacgacgaccgcaaacatgttggaggggatgaggtaagggtagatacaggcgtcatcgcttggacgaaaaccagaccaagtcatccctgtataggcgcagggagccccttttccttggtgcgtgagggtatcctctagccggtctgtatcccgttcaaaactataaggggagttttcatggtgctgctccaatttccagagttgaacaattttttcagctgccccaaagaaggtctggttaaaatgactggtttcccctgtcgctttccaaagtagataggctaattgaaggggatagcagagggaatccacctcatattttcgctcccaaatccaggggcctatctgagtgtggtcggtctggtgcccccgcccattagctgcctgattaaaggcattggcataaggatccatcaaaataaaggccatttgcctctctaccagacctacaatcatctggcgtaatttctcatcttttctagccaaagctaaatagggtttgacctgggctgtcgagtcccttaaccacatggctggaatatcccccgttaagacaaaagtagtcccatcttccagctgactaatggtcctatcaagcgtatccgtataacacctttcaaatacactcccccaacttgggtggtctgctgttttcttctgaatgcctgtcagccagttctctatgatttcttttgtgtaaaacatgatttctcctttttatcctttgctcagagttcttccaacctctatctggcaaatccatataattttcattagacacaaggttcctagtatcagtctatacaattctatatgcaaatcctatacacaaattaaacgcatttttacacaaatattgccagtttcggaaaacgctttcctttctttcccattctctatataataaggagaacaccacttattatcaataaaaaaagaaaaggatagcctatgtatacctccattgtttcaaccattgacacccgctatggtacttataactcacatgccttttcaaacggaaacaccctgccattgataggggtccctttcggcatgaattattttgctccccagaccagcgaccagactggaaactggtggttcaatccctatgaacctgtctatcagggcattcgcttaacccatcaacccagtccttggttgggagattttgcctccctcctattgacgcctgtcacaggcgaattaagccgagatagcctctttcaccgtcaatctagctaccaactggatcaggctattttccgacctgatctccttcaattacaatccaatcgctatcgcttgataagccgtttagctcccagccgatacggagccagttttgagatagcgtcttttgctaaccagcctatcggaatggtcttctattcatctggaaaatccatttatcgactgctcaatcctcaccaattgctcattcagatttttcaggtcagcgcctgccaatcccctgatttctgcatgtatgctctcctagaatttgaagaggaaataacagaatgttatcatctggtcaaggatcgcaagatagctaaaacggaagtggtgggagaagatttgcaccttcgcatcaacttctcaagcacttctatcaaggggcgtttggctacctcttttatcagccctgagcaagccgcctttctattaaaagatgttcctgacttccttcaagcccaaaaacaagcagaaaacacctggaatcagctcttaggacgtattcagattcgtgacaaaaaaacagaggacattaacttcttctaccactgcctctaccgttgcctcctctatccacaaactttctacgaacctaatcctgacggacaagccattcatttcgaccctatcagcaatcaggccaagctaggtaagtttttcaccaacaacggctactgggataccttccgctcttcttatcccctgctttcacttatctacccagattatttggaagagtttctccacggcattctccaacactatcgagatactggatttttacccaaatggctatcgccagacgagcgcggtatcatgccaggaactcttgtggatggagtcattgctgatgcggcctgcaagggacttgttcctgatttgatggaagattttctccaagccatgattgaaaccagtcaaaagaccgatgcggatcaacgttacggccgccatggtagtcagatttaccgccaattaggctatctccctctcgatttcaacgaatctgtgagccattctcttgattatgcctacagtgattgggctatcagccaagtagcagaaaaactgaggcaggaccaactggctaagcaatacgctcaaatgtgcctcggctaccgacagttattcgatagccaaacaggtctcatgcgtgccaaggatagacagaaacaattccgagcagatttttcccctctaagttggggaagagactatgccgaatgttctgccctacaggcaaccctgtccgtctttcatgacatcgatggactgatagaattgatgggcggaaaagaagccttcaccaactatctaatccagctctgtaatcaggagccctatttctcacctgaacaatacggctacgaaatccacgaaatgtcggaaatggcgcaagtcaatctcggtcagcttgctatttcaaatcaaccgagcttccatatcccttatcttttccaatggtctacaaaaccggaatacactagtctactcattcacaaaatcagacaaacagctttcaagacaggttttcaagcctatccaggtgacgaggataacggtagcctttcagcctggtatattttctcctgtctaggcttctatcctgtctgtcccggaaaagctgactaccaaatcggactaccgcattttaaggaagtagacttgctacttgcagatcaacacaagctgaccatttctactccaaaaagcgatgcaaatttccagtttgtcaagcaagtttcattagacaaacaagtcgtccaaaccatcaaacatgaccaactgataaaatcaaactgcctagaatttgacctatctatattaccaagtaactaaccagcttctacaaacaaaagaaatagtcaggaccaagcctgactatttcttttattcaccttgctttctaagcttagctaactgagataggccagccaaagccacaccaattaacccaagaaagacatacttctcctgataggtatcaccagtttgtggaagaccactcttctgcagagaagcatctctgatctgcttttcaacctgcaggctattttccaccattaaagtcttctcttgctggataggcaaaccgctgccgacctccactattttcggctgactctcatcagcaactattcgtgaatacagctcgcgacggccatcactatagactaggtgagctatcatcatttgaccatcagccccctcctgaacaattcgctctttgcccagtggcaaatcagtgctggtccgtgtgatgatttgtctcggcaccagctcataggtcaaatccattctcggtttttcaggagctagtaaattcttagactccatcgaatctcttgtaccgacatgagttaccagactagactgttcaaacaaatcagtccattcactgagcagctccttcatctcatctggacgaatactatccgaacccaaaattttctcagttttttcaagtaaagaacttagctcagaagaatttataggtctatctattcctttcacctcttggattagctgattgagacgcccaagatctgcttggtaaagtttctccccatccagctctcctaactgtttctctaaaagagtttgagcggcttcaacctgctcgactgtccgattggtatctgctaccacagacttagcttcttccaaggctgtttgcaaggcaagttgtgtctgctcactagaatagagataggctgtttgggtttgtagagcctcaatttctgctattttctgctttagatactcatcattgacgattggcttcggtgaaacaaggacatcaaatgaagtctccaaaccagcataccgcaaacctaggctctgacgcccctctttacgggaatcgaaaccaacaatttctactccagcttctgtcaaagagaaggactgagttgactcatcgtcatagataatagcaaatcgaccatttgtgacatccaaatcatctcctacaacatactgcacttttggtaactgttggatttctagaccgactgcttttttctcaccctgggctatatcttcaacaacatataccatcagtggctgagcaagtgtttctcctagataggaaacggtcaatgtttgttcacctaatttttgcggatcaaatccccttactgtaactgccggattggtggtattcacccgttcagcaggccaatctccttcaaaaactacacggaattgtgctcctgcaagcgataaaggactaccttgtcggtaaacttttttctctaggggagctatccattccatcgctttcacgactttttcaccttgcggaacgcgaatggccaatagattgctccaatcctttccttcctccagagtacggtagtaaatgaactcaggcagggactcaaagcgaatcgggtcgaatataagatttcctgactctgtcgtttccaattctgctagtggttttacggcatctggactagaataaagcgctattttccgattggcagggacatccttgaaacctacttgaatctgatgattaccgagatggcgagcaacagcatgggtcatcggaatatttggtgtctccatgtccaattcttcatacatacgccaattataaatacgaatggccttccaaggagtaccattatcagaagtcaagacatccaaacgccattcctgcgctcgaattggcttgtccaatacgatgtctgtcacatgatcacgattgccacgaacttctttggctaacacccaatcaccattctcatttttataatagagatcgaaatccttggtgttcattaagccatcattgaccgattcaccacctgcaccagcatgatccatagcccatcgcacgactgtccgaggttgggtcaaacgaatatctacatggccactcaattgatgggaagaccatttatctgacaaactggtaatggtcccattcaacatgccctcaatgccttctccaccttcttttttagcaaaacttgaaccgatgacttctgctccgagaacaatgttttctgccgatggtttaggaaggctagtatctttcaccgtcatctcccaatcaaagataaactcccctgcttccgaacgcaaaccatttttcccaacggcatgaactttcaaagcttgggttcgaccttctgcctgtgcagaacgaactagttgagggaggtaaatccttgtattagaagaacctgtcagcaatttccactgtccgtcaacctgcgcatatacttcataatagtctgcatcatctgtccctgtaaagctaatcacagcttcagcatcttgggcattcttcaatcgcttagcaaggacttggccatctttcggtgcagtaggtgaattttcttggtcataaatagccaactgccctaaacgaaaatcaaaatctgacagcgctgcttcattttcaacaaccacttggataccgtacactgtctttcctgccaaactagataaatcaaaggtctgatcttgccaatctcctgatagtttaagcaagcgccacgcttctttattcgcaaattgataatctggttcaagcgctagagctagggagatatttgcaccttgccctcctttgtgcgcaacccgtaaacgacttgtttctgatagaggaatcttggtggaatacaacttaatttcctgcttaccatctttttccaaatcgcctgtaaaacgaagagagttgcccccattataggcatcatcaaaatcataagccgcagcaagcttttcaccacttgcttcaatccaccaccgccaggttggtaaaataccagacacagaacgataattccattccccatctttggcaaccttgccatctacaaaccattttttcccgtgccctgtattaaaggaactattgaaattactgcttgtaatagccgtcttatccgcaatgagattggccaagccataccaatttttatccgaaggtttctgtttggttggatcaccttgatagcctgtaaagaagatattctcattctcatgataatcctcacccgtcgcacccaaacttgtaatggtatctggcgcaaacagaccgagtgataatttcaatttcccgttttcatcaaacagagcatcccagttaatttgcgttttgtaagagcctccccgttgcaattcaaatccagcaaaaatatcaaatggatttcgaccgattcgtttcgccacttcgattgaatagttatttttggcccgtgtccagttaaaattcgcaaagaaatgatccgcagggaccttgtctccttccttttccataaacggatagttgtactcacccaaaccatcttcgtgatagcgaccatattcgtaggtcatggcatcataccaagaatacgttatcggataaccaatcgattctgcatattccttggtatagagcatgaagtttctcattgtttcccctagtggttgaaccaagcctcctgtagtctcttgatttatgaaataaccatcgaaaccgtagtatttagccatatctaccaacttacgagcaacaggaaaacttccatcaggatcctgtctcatagaagatacaaacttctcttgatcttcaatactactggaccaattgtagaaaatcgttcccaaaacaggcacaccattacggtgtccagcatcaatgacgtctgggctaggaatcaagccttcccaaaataccattgaatcaatatactgccagtaatcaaaggcataggctttaaactcttctcccccaacagaggcatggtctttcgccttagagttggtatttgaaagagcttctacctttgcattctcattggctctctcattgacgacgtgccctctaaagcgctcaaccaactctacagaagcgcggttcaaatcatcatctggacgagcacccggctcccaagcaagcacctgatcccagttgtcaaacttaatctctttcggacgaattccttgatcctctacctgaggaaaatctgaaagcaacagaccagaatctgaagaatctacctctttatcttccgcttcctctgtatcctctagtttattttctggattatcagacggagctgaaggcagtttttcttctctactatctgatacagatgcttctccattcaactcttcggtcaccgctttctcgtctgctgaaattggtgacattccttcttcagcttcggtcttttccacatgttcgttcactacggaagagagttcaacagctggctctgacaagctgtccacattttctagctggtccgcagaaacctgtgttccaaataaggtcgcaccaatcaaaacagaacaagcacctattgtaaattttcgaataccgaatcgctgacgtttgtcgaaatcacattttgtcatattttcctcctacacaattgtagtgcaacagctgttctcaatttcctcctttccagatcatagttggcacatgctacctttgatagaacagctatcacacgaagtttatcaggttttattaattccattgtacagaggaaaaatatgaccttcaagccctcatggttcccttctttaaatcagataaaaagaactttagtttagagaaaacaaaaaagaggaagtttccctcctcgttgtcttcgttaattattttctacaaacttaatacaccaacctaccagttcatccaggcgttccatctgctctgtcatgtgcaggtagcccaagaccgcctcaaagcctgtggacatccgataggtgaccacgtccgcattcttggccttggtatggctattggtattgcgcccccgcttgtagatttcttcctctttttcggtcaatagctgagcttctaagagggcagaaatcaagcctgcctgagccttggccgagacgtatttgttagcctcgccatgcaatttgttaggcttggtcagtcccttgaaaatcaagtgccgtctgatatacatggaatagacagcatccccttcaaaagccagagcaattccattgatgagattgacatctactgccttagtcacgtgtccacctcacaccatccttggtatccaagagcttgatgccctgagctgccaattcatcacgaatacggtcagccgtcgcaaagtcccgattggcacgcgctgcttgacgttctgctatcaaggcttcaatctcgctgtccaagacttcttcttcaaaaacaataccaaagacggcgagcatcttgccaaaggcttcttttacagtttcatcgtagttgcctgagttgatccatttggcaaagtcaaagatagccgtaatcccgtttgctgcgttgaaatcatcatccatggctgcttcaaaggccgccagatgtaattcaagagctgacttatccacagagttttgcacaggttgtgtataagtattttttagatatttgagattgatttccgcatctgaaatagccttctcagtgtagttgagtggacggcggtagtgctgggtggctaggaagaagcgcaagacctgaccatcaatttgttccaacatatcatgggctgtcaggaaattgcccaaggacttggacatcttctcatcattgatgttgagcatggcattgtgcatccagtagttggcaaaggtttgacctgttttgcactcagactgggcgatttcattggtatggtgaggaaattccaagtccgcaccaccaccgtgaatatcgatggtagctcccaaaatctctgtcgccatgaccgaacactcgatatgccaacctggacgacccgctccccaaggacttccccaagaaacttcgcctgacttggcagttttccacagggcaaaatcgaaaggatgttctttcaattgaccttctccctcaacacgaccagaagccccaacctccaagtcagatagggttttgttggccaaacgagcataattctccaccttttccacacgaaaataaacatcgccagccgcttcataggcgtaacccttgtcaatcaagacctgcacaaaatcgatgatttcatccatgtagtcgataacgcgaggatttttggtagctggcttgacacccagttttgtcacatcttccttgaaagctgcgataaatttatcagacagttccttggttgtcatgcctgcttcattagcagctttgataatcttgtcatccacatccgtaaagtttgagatgtaggtcacatcatagccacggtattcaaaatagcggcggatggtatcaaaagccacgacactacgggcattaccgatatggatatagttgtaaaccgtcggaccgcaaacatacatcttgaccttaccctcttccaagggcacaaagtcacgcagactgcgagtcatggtatcgtaaattttaatcatagtttctccattacttctgagtattctttaggacttgatacttttgatacaattttactagccaataagctgtcgcggccaaccaaatcatccctacctgccagcttccttgggagaatttaaggataaacatgattgtcccagcgatggcggtcaacacataaggccagttttgtcttactaatttttttaacatgatctactttctaattttcttgcaatggccatggccacttcaaagaaggtcatactgtcagccatccgttcctctcgacgggcatcccattcattcttgtggtggtccacatagtctgccgtgtagaaaaattggtagaccttggcctgacgaaagtttgcccaggccatgatagcagaagcttccatatcgaccaccatggcaccagcggctaggcgacgcttgaccttggcagctgtttcccgaaagaaagcgtccgtggtccaggtcttagcccgcacgtgctcgattcccgcttggtccaaggccttttccatggttaatagcagagcagggtcatagctgatttcctcgctagcaggtgcgtagtggtaaccagttccctcgtcccgaagagcagagctaggaaggatgatcttatccgcagcgagcgacttatccagcaccccacaagaacccagaacgataaaattctcaaagccacaggctttcagctcttccagatgaccaactgccattggagcaccgattactgccaacatgaccgcaacctgcagtccatctctttccaaaatataccaaggatggcgaccatttaacgtctgaagatgaccaccttccctgctttcagctagctgacttactcggtccacgatttctccattgaaggagaaaatcatcgtctcacatacctctccaccaccacggatagccttgtccgttggttcaataactgcagaggtgttttcaaattcttctagtagcatatcagccttctttcctacaaatgcgacgaacgatggctggcttctctcaactctgctaattttgtcgtgtagtgttcacgaccatcttccatgtcatgaatgatcttctcatctttttgaccatgaacacggacgattttagccggcataccgaccactgtcacatctgctggaacatcggctaggacaacagcagcagcacctactttcgcattttctccgatttcaactgggccaatcacctgggcatgagcagaaacgagtgccccttttcgaactgttggatggcgcttccctgtatccttgcctgttcctccaagagttactccatggtataacattacaccagattcgacaattgcagtctcaccaattaccaatcccgcgccatgatcaataaagactcccgaggcaatttctgcacctggatgaatttcaatgttggtccaaaaacgccaaaactgactgtgcatccgagctaataatttaaaaccattttgccacatccagtgagagagacgatgagcagccagtgccttgactcctgggtaggtcaaaaggacttccaaggagttccgtgctgccggatctttttcttttacaatttctatggtatccttccaccaacccatgacttctccttctagcgagaagacaagtccatttcgggacttgcctacttcaccattattttttatctactttatgaaatttaaattcaccaaagttattatcttttttctctttgtgttctttatgacgacgaggtttttctgaacgttcacgtttttctggttccacgtagccttctggttttggtagaagagctttcatagaagcatcaatacgtcccttatcatcaatttttatcaccttaacatctacaacatcgccaacctcaaccaaatcttctggtttattgacacgtgtccaagccatttcagaaacgtggacgagggcatcggtcttgtcaaaaaggttgacaaaggcaccgaatttctccaaacgaaccacttttgcttggaagacttcgtccacttttgcttcacggacaagaccagcgatgatttcttttgtgcgctcaattgcagcacggtctggtgagaagatcgccacaagaccgtcttcgtcgatatcaattttcacgccagtttctgcaataatcttatcaatggtttcaccacccttacctatgacaatcttgatcttgtccacatcaatcttgatagtgtcaatcttcggtgcagttggtgccaagtcaggacgaacttctgggatagtcgcttcgatgacatcaaggatttcaaaacgtgccttcttagcttgtgccaaggcttcttccaagatttgtggtgtgataccgtcaattttaatatccatttgaagggctgtgataccgtcacgagtaccagctaccttgaagtccatgtcgccgaagtgatcctcaagaccttgaatatcggtcaagacggtgtaattggtaccatctgagatcagacccatagcaatccctgcaacgggtgccttgattggcacaccacctgccataagggcaagggtcccagctgtgatagatgcctgtgaagaagaaccgtttgactccaagacttctgctaccaagcggatagcgtaagggaagtcttccaagctaggcaagacttgctcaagagcgcgctcaccgagagcaccgtgaccaatctcacgacgacctggtgcaccgtaacgaccagttgagccaactgagtattgcgggaaattgtagtgatgcaagaagcgtttcttgtactcatcatccaaaccgtcgatgatttgggtttctcccattggtgccaaggtcaagacagagagggcttgcgtttgaccacgggtaaagagacctgagccgtgaacatttggcaagaagtctacttctgcatccaaaggacgaatctcatcaacacggcgaccatctggacggaccttgtcttcagtaatcaaacgacgaacttctgtatgctccatgagttccaagatttcatggacatcacgcatgatacggtcaaattcttcgtgctcagcgtatttttcttcgtaagttgcaatgacagtctcgcgaacggcattggtcgcatcttcacgggccaatttttcttcaacctgcaccgcttttttcaaatcgtcattgtaagctgcaacaatctcagcctgcaattctgggtccacttgaagaagctccacatctgctttttccttaccaactgctgccacgatttgattttggaaatccaagagttcttgaatggccgcatgacctttcaagagtgcttccaacatcacttcttctgataattctttggcacccgattcaaccatgttgatagcgtctttgttaccagcaactgtcaattctaaaagggaggcttcttgttgagcttgatctgggttaataatcaattcgccattaacataaccaacctgaacaccagcaattggaccattgaatggaatgtctgagatcgctaatgccaatgaggaaccaaacatggctgccattggagcagatgcatctggatcataagaaagcactgtgttgatgacttgaacttcgttacggaaaccttccgcaaacattggacgaatcggacgatcaatcaaacgagctgtcaaggtcgcatcagttgacggacgaccttcacgcttcatccagccacctgggaatttcccagcagcgtacattttctcttcatagttgacttggagggggaagaagtctcccgtcgccattttttttgacataactgccgctgtaagaactgtggaatcaccgtagcgaacgacaaccgcaccgttggcttgtttggcaacttgacctgtttcaacgaccaattttttgccagcaaaaaccgtttcaaatacttgttttgacattaattgtctcctattttttctgaaatttttcttgcgtgttttctacaaaagacaatcaaacaagcttgtttcactctcttttgcacaaaaccacgcatactccttattttatcatattttaggtagaaataaaggcctgaaactatttttgacaagaaaacatactcatgataaactattcaaaatagttggaggtagaaaatggaaacttgccatcttgtagttcctagtttaaaatggaagaaccaaatcctagcctataaagaagcatttagcaatgaacatcttcatggtggtggcaaactgcaacaatttgaagcagttgaggaatggctagaacacattaaagctgtgtcatcttatgggacaaatcatacagaacgttctccttcttctacatttctttgtattcgtgaaaaagatcaacagatggttggcatttgcactattcgccacgatcttaatcacgagcatttaaagaattatattggtcatatcggctattctattcacccagaagagcgaagaaaaggctatgcgactgaacaactacgaattgccctgctggaagctaaaaaattgggaattgcccaagtcttaatcaccgctgcagattggaatattgcctctcaaaagaccatccttgcaaatggtggagtttatgaggatacccgtattgaccctaatagtagcgagcgtatgctccgatattggattgaaaatttgtaatataaaaacctccaatgatactaaatcgtttggaggcttttttaagttaccgattattgaactctcagaccaaatactcgttttatataaaggtaaaatgaaatggatgtttcacaaaatctaacaaagggacatcgctttcatggacatggccaacaaccatttggcggtcgtcctgaggcaagtcgaccaaacaaatttctagttctgattgataacgaagaaactgttcattagcaagaacaatatctcctcgttttcgatgacttgctggcccttgaattgcatatccttttaactgagcccttgaatggctagcacgtatgacatattcactgcatcaattctattttcgaaattcattcccttcaattgctttggaaactgcgctgataaggctattataccctttgtcaaatatgaaaatctttctaatgaagcactcgataaggcattatccccaatacaaacataatcactttcacaacacatcaaacaatcgagtgcggcttgaattggaggcaacgctctatgttcttcaacggttggaagtccttcaaaaagcggaaaacgcttgttatctccaggaataaaggtgatgacttttattccacaagagtgtagccgactatttaggtcacggacactacttccccctaaacctgtataaggcttaggataataattatgacatgccaaaacttttgttttctcaataccaacgtccatcatcttccttaaaaaatcatctgacaatgtagatgcatttaagacaagtaaaaagtcttccgacaatgatttcatgacttcaatagtaattccatcatcaatcctaagtgctttaataccgagctttttaatcccttcattcccatatcgcttcaaactatcttgattgatatccacaatcaaggtcagcccttctcgttgacattttgttacaatatgacgaatcttttcgtctcccttctcttcttcatttatattaagcgaagagaaaacaaaggaaaatcctgcattttgatattctataaaccacttttccgaattagcaaatgagttagataaatagagtgaaaaaccgaaacgactgaaaaaatcattaacttccatatacggtctcaattctatcttcatccacaccaaagaaccaagttagtacaaaaccacctacatatgcagccagcatcgctataacaaattgcagttggcttccaggtaccatgattaacagtccaaacaaaccagaaactccttgagatacagtccctaaatggaataacactgccaaaataccgccaaaacctgaacctaaacaagcggttaggaaaggtttgcccaatggcaaagtgacggcgtacatcatcggttcaccaattcccaagattccgactggaatagaatctcgtgttagttgtttcaactttttattttttgttttcaaaaagagtgctaaaccagccccgacttgtccaccacctgccatcatcaaaataggcaagagataatttataccacctgttggcccagatggatcattcaacaaaacatgtattggagtcaatgcttggtgtagtccaactgataccaatggtaagaagcctgctgacaaaatatacccacctactatacctagcttctcatatacaaaatttaatccactataaatagctgtggttaacacttctccaagaggctgaatgactaacaaagcaaccagaccacccaatattactgtacaaagaggagtcaaaaaagtgtctaaaaaacttggcatatattttcggatatttctttctagaaatgcaaagaaaatcccaacaaatagagccgctaacaaaccgcctgcactaggtgagaatgccttgtccacaaaaggtaataaaattgatttgtcatccactactgtcaacaaaggcattgaaggaactgccacagacatagctccggccattgctcccaaaatcggacttcctttaaattctttcgccgcattcattccaacatagattggcaaaaaagtaaagagtccccaactcatagtcctaatacattgataccaccattccattgcaaaagcattcccggttgatacattaatgacatttgtaatcccatttatcaaacctgccgcaattataccaggtaatataggtataaaaatattagcaattttttgcaagaatcgttgaactggcttgtcgtacttctctttatttatccttttatttgtagcagcaacatccgctgttgtgtaatcttcttcaacacttcccaatgatatacctgtcagttctgaaaatgcttggccaacctttgtcactgttccaggcccaaaaacaatttgaagtgtatctgcctcaacaactcccaaaaccccttctatgtttttgagactatcaaggtgaaccagcttgtcatctcgtaactgtaaacgaagtcgtgtcatacaaactgcattccctaggatattttccctgccaccaacattttcaagaacttgctttgcaacatctttcgtatttttcattttaattctccttatccaaaattgattgaattgcaaatgaaatgtgattatgatagttttccagaagtttttttgcctctatttgatcaagttgactcaactgcatcaagatggctaatttcacgtcttggttggcttgttgaaaaatatgttccgcctccatctctgtacagccagttgtttcacaaataattctttttgctcgttgaatcagtttttgattggtcggttgcacatctaccatgaatcctcgaaaaacttttcctagttgtatcatcgaggtggtagaaatcatattcagaatcattttttgagctgtcccagctttcattcgactagatcccgttacaacctctggtccaaccaatacttcaatcggagcatctaccaatggggagatttccgcatcttgtacacaggaaatactggccgtctttgctccaatttcacgagcatatgtgactgcctcaaggacatatggagtcctgcctgaagcagcaagcccgataaccacatccttcgccgatataccaatttgttgcagatcctctacagctgctgctcggttatcctctgccccctctttggcggcacgtacagctccatttcctccagcaataagtccttgtactaactctggagaaactccaaaagtcggcggacactccgaagcatccaaaactcctagccttcctgaggttcccgctccgacatagatcagtctaccatcctttttcaagcagtcaacgactatttctattactgcattaatttggggcagtatacgttgtacagctaaagcaaccaggccatcttcacgattaatgtaggcggtgatttccccgatagacattgtctcaatagcaaatgagtctggattggactgctctgtattcaatcgttcaatatccatcttattctcctttctttttttgtaaacgtttgctataatcgtattatacaacttttgtattattatttcaatattttttagaaattaaagaaactttataacagactgtgttagaagggaatcattatgaatagaaacattttaaatcactcgatagagaatttaacccctaccgaaaacaaattattggattatattgaagagaacatccatcgtattgaaacaatgaatatctatcaattagccgataacgccggagtatcaacagctacaatcagtcgaatcagtaaaaaaatgggctattctaactttaataagttaaagatagaaatagccaaatcgaaatatgatgatttactcaatgctcacttcacgccatcagattcgattgacgatatttctactaaattaattcattcaataacaatttcaaatcaacaaaccgtcagttttctaaacttggaagaattagaagccgccgtaaaattattacaaagcgcttctcgaatttatttatttggagttggggcatcaggtattgtttgcagtgacttttactacaagctgagtagaataggtaaaacatgtatttttgcacaagatacacatattcagatggctaatattgcaaccgctggaaacggtgacttagcaatcggaattagttatagcggaatgacaaaagaagtcgttgagccacttcgtttcgcaaaagaaaatggagtttcaacgataactatcactggaactggtaagaatcaattagcagatttagccgatattacatttagaatcccacgacatgagcatgaacttcgagtcggggctattacatcacgaagcaactcacttttcctaaccgacttgctttacctagcacttatccaggatcataaacaagagattacagctatcttagaacaaacaaaacatcttacagaagtaatcaaatagaccacctgataaatccactacaaaaagcaaatcccctaagctcgatcgaatcttttattgaagcaactcatacaatagggaaaaaaacaaaaaacacagctcagtatacaagatactggtgctgtgtttttttgtttctatacctgctaattaacgacggagtccgagtgagtgaatcaattcacggtaacggttaacgtctgtgcggcgtaggtatgccaacaagttacgacggcgaccgatttttttcatcaaaccacggtaagttgcgtggtcttttttgtgttgtttgatgtggtcgttaaggtggttgatttcccaagtaagtactgctacttgaacttcaactgaacctgtgtcgccttcatgacgagcatattgtgccatgatttcattttttttctcttttgagattgccatgatatgttctcctttgtttttgagcctaatccgagtgacaggttggcgacctgtaaccaagaaaaagctagatttgtccttttggacctcatttattctatcaaggattgtcttttttgtcaactgatttgaaaactagctgagtagctctgctattttcaaaaaaagccagcttttgctgactttctgcttgtatatcacatttactctgccttttctgcttttggcaagatgagattgaggataatacctacaatggctgagagggctgtacctgaaagggtgatggcaccgatgttgagaactgctccaccaagacccaataccagcattgagcttgcaataatcaggttacggacttgaccgaaatcaacacggctctcaatcaaaactttcaaaccgtttgaggcgataaccccgtaaagcaagatagacatgcctccaagtacggcacttggaatagtagagataagggatgtaaatttacccaagaatgagaaggcaatggcaatcaaggctgcattacggataacggatactgatgcgatgcgagtcataccgataacccctgtattttcaccataagtcgtgttagcaggtccaccgataaaggcagatacggcagtcgccacaccgtcaccaatcaaggtacggctgaggcctggatctttcaagaactggcggccgcagatttggctgagaacggtgtggtcaccgatatgctcagctactgttacaacagcaattggtaagatagcaatcatttctggaccgaagtagaaattgtacgacttgaaggcacctgtttcaaatggtaggtagaaacctggtaattcaaaccaagctgcttccagaacaggtgtgaagtcaaccaaaccaagacagagtgcaatcacgtaaccaccgatgatggcaatcaagaagggaacaatcttggcgaagcctttccctttggtattgacaaaagcagcaatcaagaaggttgcgatcgccacaacgacgtttttccagtcaccgtctgcgacaaagcctgccgaagtcacggcagagttggcaagacccagaccgataacgataatcataggaccgataacaatcggtggcaagagggtatcaatccacttggtcccgataactttgacaagcgcagcaatcaagacgtaaatcaaaccgacaaagagaatacctgtctgcgcagctgacacatcgccgcccatttccttaatggcgagggccatagctgagatgtaggcgaaggaagatcccaggtaaaccggcaccttaaactgtgtcgctacttggtaaatcaaggttccgacacctgatgcgaagagagccacggaaactggcataccgagaatcagtggcaccaagattgtcgctccgaacatagcgaacacgtgctggaaactcaacaaaatcccttgaagcggtgctggtttctcatggacatcaaacaaaagattggcttttgtactcataaatctcccattctgggtacacaaaaagacccagactttctaaatatacatagtcataggcccttaatgaattatcctgttgtctttctcacctcacgggatgagtttaaaaacctacgcttttgatattgtaacataagcccttacttttggcaaggaattttgtaaatttttattttttagaaaaatggctgagcaggagctgaactgcttattattactccatttttccaactctttttccacacgagctaactttaaacgaatatttttcatgccatagccatcctcctgtgcatttttataattttattacacactatattttctattttgaaatatatatcttacatttcgtttaattttttaacagaaaaagaagacaatattgccttcgtaatatacgtacatatttaggtattactctccctactccacactcttaatccgtttcttaatcttctggctaaactcaatcatcctccccttttcctccggccagattttggtcacgcggtcaacagcaattatgaagatgattaccgcagcatagtccttggctttttcaatcagaccaacactttcagcaactactaaaagtagatagaatgtgaataaaatagttcgtttgggtaacgccatcaaaaactcaatccctgccttatagcccagataaatctgccgattaagccctttggccttttccaaacgacgattgagaaaggcacgaatccgcttgtaaaaccaatccgaagttagaaaaagtgattgggcaccaattacaatcaaagaaacattattggcatgttcttccttaagccctagcgctctagtcacaacataggtccaatcaccattatcaatacagataaaaatagtaaagtaaacaaccgctcccgctactataacaaggggaagggcacggatatatttcaacatataataacctctcttggacaattcttagaacctatattcataaacaaagtgttcttatgcaagatatcgtttttgctcatcaaggcaattttttgaaggaatacttgactctatcaccatttagtttcactttattgcttcgacgagtaaaaagctcctgtggctgttttcgcctaccacctaattggtcaggaatctcctttccttatctccaccttcaaacactccaatggaagctatgaactgtgaacacaggttcttgtatatattgtaatatgttatgccaagtacggtcaagtaggggctagaatttcaggtacgacaactgtacacccttagcattttttacttaccccaaaaagaagaagacctccaatcgggagcaagtctcttctatttatctataattccacaccaaagacttctaattgctttaattcggcagcagtcaacctgcggtattctccaagcgctaattttggatctaagcgaagaggccccatggtcaatcgttgcaagtctgtcaccgtctttccacaagcctgcaccatgcgtttgatctggtgaaatttcccttctcggatggtgatgtcaacgagcgaggtctgcttagcttcatctgtagagaggatggtcaactgggctggttgacaggtaaagtctttcagctcaattcctgccgcaaatcgttcgacatcctcttgggtcatgatcccgtcaacctgtgctcggtagagtttatcaacatgctttttcggagaaagcatggcatgagccagctgacccttgttggtcaaaagcaagagaccgtgggtatcgatgtccaagcgtccaacaggaaaaacttccttctggcgagctgtattatctagcaggtccaagacagtccgatggtggtcatcctcggtggctgaaataactcccttaggcttgtttaacagatagtaaacaaaggtttcatgactaaggacctgacctgctactgcaatctggtcttttttttcgttaatttgctgtttgggtgatgtttctacttggccgttgactgtgacttgcttgtttttcaggagtttcttgacttctgtccgactgccaacaccgcaatccactaaaaatttatctaatcgcatacgagtttcttttccattttgatatattctgcttgcttttctatttctgtaaaaccaagagcatgaaagagtttttgggcaacttgatgagagctagcaactgtcagtttgatactagctggctgaacatgctctactaaatagtcttcaatagcctggtagaaagctctgccatttccctgacctgtcaaagaaggtttcatgcccaaacgaatgtcaactgtctcgccatcttggtcaatacagaaatagcccatgagggcagcattgcggatgactgcaaaaaagcggtccccacgcgcctctggtgaaatcatcacagcataaatctcggggtttgcactaatcgtataggcatccaaaggtggttgatagcgccattggttagcaatttccaatgccagatcctggggcaggggcatgatgtaaaaataatccattcttcagaaattttttgctaaatttttaatccgacggttttgggtggcgtaactatctgtctgataaacataatccacatagcccaactgataggagggaatcatgtccttaaaaatcaactgaacatcctctggaaaacggagtattaattcatttaagcggttattttctaacataagaatattataccaaaagaggctgggcaaaaagcccaacggctactacttagagttcgtgtcaacatctcagcgcagtggttgattggcagatttgttcgtgtattacactccaaatctgacctatacgactgatgcgaacagagttcgcttcatctccaacctcaaactgtctcccagacagtttgagctgtgcgggggtgggagtgaaacagtctggggatagactgtttcagctcaacaactggaaataaggacttgttgacgaactctttttagaccagtcgagttctttctcactcccacttcttcagttgtttataaatcaagcctgcgcttatcaaggcacagccgatggcgtaaataccaaaggcacctgttggggttgggttgagtttttccagataagtcggcaagatagcagatgtcgcaccgccgatattgcagcccataaggacgattgtcatgaccgcattgagcaaggccttgggtgcacggtctgttacctgactaaagacaatggttagaatgatgctgtagaaaaatcctgacaccatgccaccgagtcccagcacccagagattatctgcaaaggcaatgccgacaaccgcgagtccaaagaccacgtaggaaacagctaaaagccagcccttcaaacgaccaaccaagctactaaagaccgtccctgccacaatccccatgacctgcataagacttagaatgagactggcttgctgagcagtaccgatgcccttggctaaaacaatctgaggaatacgaatggtcaggaaggtattgacattgataacaaagaaggctaagaatgccagataaatgcccatcatccacatggtcttgtccagtttgaccttgggcgcgttctcctcaacctttacctccatgcgagacagcaattcctccttgggtacgaaaataaggaagagagccaagatgaccaaggcaaaaaggtagaccaagaaggcaggttgccaaccaaactgggtcaaccaaccgacaagtagggtaagccctgcacttcccaaaacctctgctgaaccacgcaagcccatcatctgcacccgctcctgaccggtgaaaaaattaccgatgatattaatagcacgcgcattgattaggccaatccccaaaccaagcaagatgcgagccaataaaatcagaggataagcagttagaaacatgggcaaagctccgccgatggccataagcaaaagccctgcaatgataatgtttcgttcagacaagaaacggacaactagaccgtttgccaatagagtaaccataatagcaaaagaggtcaccgtaattaagttttccacctgggccgctgcaattccctgctgggcaaaatactcaatcatctgtggaatagctggcgagacagcaaatgtcgaaaccagcatggtggatagggccagcaaactggctttttctaaaattcttttcatttttctccctttcaacgttcgtcttttactagtataacagatttgaaagcgaatggatagaaaagtccgacttttattctctcccatttcatgctatacttatcttaactatattcaaaggagagaatcatgtctgttattgaacgattgacaaaagctgcccatttgattgacatggatgacatcatccgtgaagggcatccaaccctacgccaagttgccgaagaagttgcatttccactatctgatcaggaaattattttaggcgaaaaaatgatgcagttcctcaaacattcgcaggatcctgtcatggctgaaaaaatgaaactccgtggcggagttggtctagctgcacctcagattgacgtttccaaacgcatcattgctgtcttagtcccaaacccagaggacgaggaaggaaatccacctgcccaagcctactctctgcaagaagtattgtacaatcctaaaatcgtggcacattctgtccaagaagctgctatggaagggggcgagggctgcctatccgttgaccgcgaagtccaaggctacgtagtccgccatgcgcgcgtgactgttgattacatggacaaaaacggagaaaaacaccgtatcaaactcaaaggctttaatgccatcgtggtccaacacgaaatcgaccacctcaacggtgtcatgttctacgaccgcattgacccagaacacccatttgccgttaaagaaggcatgttggtaattgaataaacataagaaactgactgaaaaattttcggtcagttttttatgtgagtacgaaaaaacgaccctttcggatcgatctcaataatagtcttttagtttacttttagtactaggcaacgagccgcaggcataactggagttaggcaaggtgagttaacgacgtaataaaagataaactaaatgacgatatcttagtaatattccccttgtctgtagtcccaagagttgaaatggtcagacaaatgcatcatgattttatcaatgtccagacccttacggatgacaactggacatgggctgatagaacggctatccgcgctttgttctggaatgagtttaccatctttgtctaccatagacaccataaccccttgctcatagcgggtttcaatggtcttgtctggctggatagatgtcacataatcatccgcctcgataatcaagtccactttagaagcgatacgctcaccgataccttctaccttgccacgatttcccttacctgacgggttagcagatgacgcatagaccatacggccttctttttcccacatttccttagcaatctgctcgcctgctacaccaaacttgataacaaagcaagaagtaccacgaacgtcggtcatcaactcttcacgaccatcgccataagcctgcaacttagcataagcctctggtttccacggcaggatacaacccaacaaaatgtcctcatcccaatgtttttggtagaaggcatcaatctcaggagtcaactgtgccaactcacgaagctcctccatgctaccacaaaggacaacgcctggcttattccgcttgcgctccttagcatcaaacttacgctccaagccagccttgtcagcagtcatgatgatgtaaccaaccttggtcgggcagacaatcacgcctccctcacccttgataatgtcaaaaccttcttgtgaaagtccgccatcccagtgaatttgtttcgtcataataatttcctcttttcttttgttccatagcagagcgatctgcttattttctaatatttttagttttgccagtagcttgggcgattatcctcatactcagcaatcaaatcctgatactgtaaggtaataccaatatcatccaagccattgagcaacttgtgtttccagtcctgttcgatgtcaaatgggcattccccaaaaggcgtccgtatcaactgatctgccaagtcaaccgtgatttcttggtcaggacccagctgagctagttggtccctgacttctttgggctggataatgggcagaatcccattgttcaagtcattgttgtaatgaatatctccaaaggagcctgcaatgatgaccttgaagccataatctgccagagcccaagcagcgtgttccctagaagaacctgctccgaagttatccccagatatgaggatactagcgccttgatactcaggctgattgagaatgaaatcaggattgtccgtgtagttatcatccaagtaccgccaagcatatagcaaatacttgccaaagccctttttgtcaatcagcttgagaaactgcttgggcaggagctggtcggtatcaatattatcattcatgagtggaacggttgtccctgtccatgtggtaaattggtgcattagactcccgccttgagaatgtctagctgtctggtgtcgacaaaacgtccataaagcgcagctgtggcagccatagcaggactacacaagtgggtcttggccccaaagccctgtcggtcttcaaagtttcgattacttgtagaggcgcagtggacacccgcagggaccttgtctagacctaacttttctgcagcacgcttgacagggcgactgcctggtacgacaatagccgtaacctgctctgctattttccgccccttaacaatcctagctgccagctgcaaatcgctgaggcgagcattagtacaggagcctaggaagacatagccaacgggaatgtccgcagccttttgcccaggagccaagtccatgtaagcatagacccgctcgtcgttgtggtcacggatggatgggaaagtttcgtcaaagctaacccccatagcaggagtggtcccccaagtcaccatgggtgccaagtccgacacatcaaggaccaggtgcttgtcatagacggtgtccgcatccgagtagagctccttccagtctgccaccgccgcatcgaagtccgctggtgcacactcccgacctcgcaggtagtcaaaggtggtctggtctggagccatgatgcccaaactcaatggacatattgcagatggtcatccgctcttccatgctgagtcggtcgatgacgggtcctgcgaactcgaccacatgacccaaaccacaatctacgccgtagcgggcaatcagagccaggataaagtccttggcatagacacctctttgcgcctgaccgacaaactctactaggagtcgcttaggtttgacctgccaaatggtctgggtagcgagaacgtgctccacttcagaagtaccaatcccaaaggcaatagccccaaaggctccgtgagtcgctgtatggctatctccgcagacaatgaacttacctggctgggtcctgcctgtttctggtccaaccatgtggacaatcccctgatgttccgaaccatgggctgcgtggggaatgccgaaatcttctatattcttagccaaggcatccatctgagccttggaaatgacatcacggatattgtgaatatcaacggttggcacgttgtggtcaaaagtcgcaaaggtcaagtctgggcgccgaacagatcgccctgtatccctcaatccttgaaaggcctggggactggtcacctcatgaatgtagtgctggtccacatagaggagctggggctgaccttcttgccctgtaatcacatggcgatcccagagcttatcaaaaatagatttgccactcatatttacccacctccaatttgggcaataatggccgctgtcatttctttggtagatgcgctaccacctagatccttggtaaaaatgccctctgcaaagactgcttcaactgcctggcgaatggtctgacctgcttggaccaaatcaaaactttcttccagcatcatggcaacagatagaatcatactgacaggattggcaatgccctgacctgcaatatcaggagccgaaccatggataggttcgtagagactgggacccgccaccgcatgactagcagaaggcagaacccctagcgttcctgttaatacgctggcctcatccgacaaaatatcaccaaagagattttccgtcaccaagacatcaaaccgactaggattggtaatcaaaagcatggctgcgctatccaccaactggtgctccaagaccacatctgggtagtccttcgctacctcatccgccaccttacgccataattttgacgttgctagcacattttgcttatcaatactggtgactttttttcgtcttttttgggctaggtcaaaggcagagcggacaacccgttcgatttcctcagcttgataggtattgctatcgctggcttggtcagttccaaggatatgctctccaaaataaatcccgcctgtcagctcccttaccatgaccaaatccacaccgtccagccggtcgaccttcagaggagaatagtctttcaggctatcaaaaattttcaccggacggatattggcaaagagacctaattccttacgaagttgaagaagaccttgttctggacggacagcggcatcatcatattgagggctaccgatagctgctaacaaaatcgcatccgccttacggcaggcttgtaaggtttccttaggtagagggtgcccgctcgcatcaatcccagcgccaccaaaggctctctcctcaatctcataatcaaatcctacttgcccagccacagcctcgaggactgctaggccagcctccatgatttcaggaccgattccatcaccagccaaggctacaatttttttcgtcatatttcctcctagatgtgtggtaactctttctcagatagtttcttatcaatctgtccgctattttctttccgtaccatgacattggcatgaatataggcaatggcagaagccttcaccacgtcaaagtcaataccagaggcattaaagaccgtttccgttgccttgttttctacggcgacaagcacacgcgcctgggcatcaattccatcggtgatggcgtcaatatggtagcgttccaagctaatctcttggtggaagaattggtcaatagcattaaagacagcctcaacagaacccttgcctgactccgaaacaaccacttcttcctcatcctgattgatgaagatgacctgagcctgaatacttccgtcagactgactatccaaacgcaaatctttaaattggaagccatcacgattgctgatttctgtcccagctactagagctcgaatatcagcgtccgtgattttttccttcttgtctgccaggtttttgaaacgagcaaacaagctagcaacgtctccttcttcaaaatacaggtctagttctttcagcttttctacaaaggcatggcgaccagatagtttacccagtggcagagaatttttcttgacccctaccaactcaggtgtaatgatttcataggtcgatggatttttcaagacaccatcttggtgaattcctgactcgtgagagaaggcattgccaccgacaaccgccttattgcgtggaatggcaatcccagaaaaacgagatactaattccgaagtattgagcgtttcctttagaacaatcggactggtcacatcatagaaatctttccgaatttcaagggcaacagctacttcttcaagggccgcatttcctgctcgctcaccgataccgttgatagttccctcgacacgaccggcaccgtttttaatagctgaaagggtattggcaacagccattcctaggtcattgtggcaatgtggactgaaaataatctcacggtccgatttgacgtttgttgtcaagtaacggaaaatttctccgtagtgctgaggagtcgtaaagccgactgtatctggaatgttgatgtaggtcgcacccgcatctaccgctgtctgcacaacttctagcaaataatccaactccgtccgcgtcgcatcctctggtgagaactccactacctcaaaacgctcacgtgcatagctgacatgttcagtgatttgcgccaaaatttcttctttggtcttttgaagtttaaattcacggtgaatggggctagtcgcaatgaaaacatgaatctgcggatacttggcatctttcagagcctcataacaagcatcaatgtctgattttactgaccgtgccaaacctgtcacagccgtcttggtcatcgctgccgcaatctgacgaaccgcttcaaacgaatcaggactggccgcaggaaaacccgcttcaatagcagaaatcccccatttttccaactgcttggcgatggtcactttttccttgatagaaaaattcacacctggcgtctgttcaccatctcgtaaagtcgtatctaaaaattcaatcacacgcataagaatacctttctaaataaccctaacgtcaatattaggttctctttcttagttttcaaagtatactaagaaaaagaaaacacctcgaggactattacctgcgagatgttgtcaacagcgcccgcttggtaagccaaacaggactaatgctacctagtgcactagcccgaccgtcgcaacaacaaagcaaagaattttgtagtgacaggtttcatttgactttttcctttcagtattttaattatttacaatgataccctacttattttcacttgtcaacagaaaaatggaaattttctgaaaaatccgaacaatgcggcaattcgtacaaatccagataatagaaaaccatgctccaattgaagcacggttcaggtgtttaattccgtctagaactgctaaaaatcgccactaagagaatagcccctagaacagacggcactacagccataccagcaaactgtagtccccaatcaccgaagagcagttgtccaatccacgaaccagcaagtccaaggatgatatttccaagacaaccacgacggtcatctgatgaggtcaaagcccccgcaatcaagccaataatggctccagcgattatacttgataacattctattttcctccttatttacaaaataagactggtctcccagtcttatagcattgtttttagatagcccactcaccgtcacggaagattggcacacgagtaccgtcttcacggattccgtcaatgttcatcttgttagaaccaatcatgaagtccacgtgaacatctgagcggttgagaccagcttctttgagctcttcttggctcatttctgtaccaccttcgatagagaaggcataggcttgaccaatcgccaagtggtttgaggcattttcatcaaagagagtgttgaagaaagttacacctgattgagagattgggctcttatctggtacaagggcaacttcacctagaccgcgtgcaccagcattgtcaaagaccagtttcttcatgacttcgtcgcctttttcagcagtcacatctacaatctcaccatctttaaaggttaccttaataccttcgataatattgccgttatagctaagaggttttgtagaagttacataaccatcggccacacgatagtcaggagctgtaaagacttcttctgttggcatgttggcaataaacttctcaccttgggcattgatcgaaccagccgcttcccataagtggtttttcggcataccaagaacaaggtcggttcctggtgctgtgtagtgcaatttgacaaactgctcgtcgttaagaaccttagcttttgctaccaaacgtgcttcatgctcttcccaggctttgattggatcttcatcgtagatacggcaagtcttgaaaatttggtcccaaagtaagtctactgcttcttcgtcagacgttgcatttgggaaaacttttttggcccattccaaaccagatgctgcaccaagtgtccagctgattttgttagcttgggatgcttgccgcattgggttcaaagcctggctgagtgcacgagcgttgcgagacaatttctctggatccacaccgtcgtaggcccctggatcttctgacaagacaaccaaacggctggccttccgctccaagaggtagttcatttcagtgatgcgttgtgggtgaacttgttccaagagttccacatctacattgaccaaacgctcgcgcgcaatcacatcgtccaaccagttgaccaagacttccttagcaccgtgagcgtaagcttctttgacaatcaagcgtgccaactcagcctgttccacaccaattgtcaattgaaccgtgtgaccaggttggacattgatacctgttgaaaccaagagtttagcatatttagcgagattttctttaaaatttggtaataccatctttttctcctttgtactttgaaataccctattattgtatcatattttaagctagacagataaaaaaacttcctgctgatacaggaagttgaaaaggttagctctgggagatagttgaagcttggagatgaaacgaatggagttcgtgtcaacaagctgcaggcataaccctgctcctctcttgttttaagggaacaggctgaaaaactccactggagctttacactcaccacatcaagtcaacaacgtctgatcccaattttcgcagagtattagttaccaaaaacctttacacggtcagaatccgccatatagtctttgtctgctgctggagctgcaatgcttccgaatggtgcttgggcgcggagtttccagttagctgggataccgtatttttcagcaacttgtgcatcaaccaatgggttgtagtgttgtacgttcataccgatatttttctcagcaaaggccaaccatactgcgtacaagttgataccatgagcttgttcagaccagattgggaagttttcagcgtaaagtgggaagctttcttgtaagcctttcaccacgtcttggtcttcgaagaacaagatagtaccggcaccagccgcaaaaccagctaagcgaccttttgtagcttcaaaagcttctgcaggcgttactttttccaattcgctgtaggcaatttcgttccagaaaacttctgactccgcaccaaaaagtaccactgcacggctagattgtgagttgaaagctgatggagattctttcatggctttctcaacaagtgctactacttcttcatttgatactggcaagtctttaccaagtgcgtagattgaacggcgagtttcttgaagttttgcaaagtttgacatatgttttcctcttttctatttgttactacatagtagtttttatcactatagggagattgtatcattattactaagtagtgtcaaattcctagtctgacttttttatactccgtgaaaattaagctagttacagcagatagtctgattttcataaagtagtgacagagaatttacaaaaagatggcaaaaaaagcctatcaaatacttaagatacattgatagacccttctttatcttatagccccaacatctcgtctgtaaaatcagtcagcgaatgttccttataaaattccaagtccttcaggcgaatgattttggcaatgacgctaatcggaaactgatgcaacagagtattgaaatactcaacctgctgattgtatgaaatcttccattgtgctaaattattttctgtttcaaaaatttcattcagtaacctttcaatatgtttattggccatcaattccggcatttgacgcaaaaattgaccaaattcttgtgaactttcaatcttggtggatttcataacagttttttcttcaaccgttcgaattttggaaacggatttattgatgtccaaaatggtttctttttcaagattctggtgtttttcaaccaagcggtttgctttcttcatcaaggcctgattgcgctcttcaataacaacgatatgacttttactagctttcgcggcttgttcagcctgacgaagttggttatacttcataatgatatggagaatgaaactcgttagtataccagcaatcacagtaaaacctggaaaaggttcgtaaatacctgatgatgattccggtgtggcaaaagataagatcaatgtccacaagatagtagaaagcagtactagaccaattccttttaataactcaactaaaatatttctttttttcatcatttccttttttaaaacaaatcatcaaagagactcaactggttatcctctggcattttaccgaggatgcccatttcatccattttttcaacaagcgtacctgacaatccaccacgtttacggagttctgtcttggagagaaattctccttcggcacgcgccgccacaacctgcttggcaacgttctctcccagaccatccatagcgacaaatggtgggatgagggtatcttcttcaatcagaaagtcggtcgcatgggatttgtagaggtccaacttaccgaacttgaagccacgttccagcatttcatttaccaattcaagtgtggtatagagatcctgctcaacgttcgaagcttcattgtttttcttcttgagggcgatttcttccatcttagccttgactcgttccaagccaccggacatggttgccaaatcaaatgccttggcccgaatagagaaataagcgcaatagtagtaaagtgggtgatgaaccttgaaataggcaacccgcaaggccatcataacgtaggcagccgcgtgggctttagggaacatgtacttgatttttccacaggattcgatgtaccagtctggcaccttgttatccttcatggcttgaatgtagccatttcgctcttcctcagaaatcttgagccacaagcccttccgcacccgctccatgatattaaaggccatcttaggtggcaaacctgcgtgcatgaggtaaaccatgatgtcatcccgacaaccgataacagtagatagattagcaattcctgccttaatcaagtcctgggcattgcccaaccaaacgtctgtaccgtgcgatagaccagataactgcaagagttccgaaaaagtggtcggtttggtttcctccaccatcccccgtacaaagttggttccaaattcaggaatgcccagcatacctgtcggtgtcccaatctgctctggggtaacacccagaatttccgtaccagaaaaaagagccataacccccttatcatcagcaggaatagtttgcggatcgatgcctgacaagtcctgcaacttccgaaccatggttggatcatcgtgtcccagaatatcgagtttcaagacgttttcatcaatatcgtggaagttaaagtgggtggtctgccagctggctgtcacatcatcggcaggatactgaacaggggtaaagtcatagacatccatgtagtcaggaaatacaataattccccctgggtgctgaccagtcgttcgtttgacaccagctgctccagcagccaggcgttctacttccacatctctatagaatttgccataatcccgctcatagcctcggacaaaaccataggcagtcttggcagctaccgtaccaaccgttcctgcacggaaggcattttcttcaccaaaaatatcccgaacatccaaatgggcagacggttggtcatcccctgagaagttcaagtcaatatcgggaaccttgtctccatcgaaaccaaggaaggtctcgaaaggaatgtcctgtccatcttttttatacttggtcccacacttttcacaatccttgtctggcaggtcaaaacctgaaccataggaaccatctgtgataaattcactgtgttgacaatttggacagacatagtgaggaggcatagggtttacttcggtaatcccaatcatggtcgcaacgaaactggagccgacagacccccgtgaacccaccaggtagccccgctcgttggaacggtgcaccaacatctgcgatgccaggtaaatcacggcgaatccattacctaaaatggaagtcagttccttttcgattcgcaggtcgataatgtctggcaaggggttgccataaatctcaaaggctttctgataggtcaattccgcgaccgtttcctcggccttctcaatataaggcgtataaaggtcggtcttaaccacctgaacatcttcaaaccggtccagcatggcattgggattggtaatgacaatctcacgggccagactttctcccaagaatgcaaactcgtccaacatctcgctggtcgttctaaagtgggcttttggcagtggtgctggctgagcgttttcaccatttccgatggtccagttaatcggtgccccttgacctagagcacgaacaatgatttcccgataaatttcctcttctgggtcaatgtagtggacatttccagtcgccagaacaggcagacctgccctacgtcctacctcaatcaactgcttgatagtctcttcaatctctgccatgtccttaaactgctccttggcaatcatgggagcatagagggcaggtggcataacttcgataaaatcataataggctgccgttttaaccgcttcatctatccctttggagagcaagtcatcgaagacctcaccctcttgacaggctgttcccaatattaaaccttcacgatgggcattgagaacggtccgtggaatacgtgggactccctcaaaatacttggtattggaaagagagaccagtttgaacatatttttcaaaccaacctgattaatcacatagagcgtggcatgcttgacacgagccttcttataggaatcctccgcaatcagctccgtatttagctggttgagattggtcaaattgtgcttctccagagcatcttttaggaagatgaagagcaggcgccctgtcgcctccgcatcgtagttggccatgtggtggtgttcaagagcaacaccaaaccgcttggtgagaggacctaaaccatgacgcttaaagtcggggtaaaggttacgagcaaattccaaggtatcaatgacaggctggctaataataggtaagcctgctcgttcatagttgacattcataaagccaacgtcaaaggtcgcgttgtgggcaaccatgacggaatcttgacagaaatcttgaaactcacgcaggacttgttctagaggtttagaaccacgcacatgctcatctgtgattcctgtcagatctgttgtaaattgactgagcggatgacctggatcgataaactcatcaaattctgcaatgatattgcccttgtgcatcttagacgccgcaatctgaatcagggcattgttgactgcagacagaccggttgtttccacgtcaaagaccacataggtggcatcagacaggactacatctgcttcgttgtaagcaatgggcacagagtcctcgacaatattagcctccatcccgaagaggggcttaatcccagctttacgagcagcatgatagccatgggggaaggactggacattgccgtggtcggtaatggccaccgccttgtgtccccaggctgccgcacgcgccaccaagtcctcaacggcaggcagggcatccatagtggacatgttggtatgggcatgaaactcaacccgcttctcaccctcaggcatgagatctttgcggatttccttcttgacctcttggacttcctgtacgttcatagtcaaatcacgagtgaaattattggtttccacattgcctcgcacccgcagccagtttccctttttgaccatatcaaacttctgagcctcttcctcattcttagcccacttctgcaaggtgaaggacgaagtatagtcggtcatcttaaagttgataatgacccgccccgtcttggtcgtcttctgctcgacctcaaagaccagtccctcaaagacaatccgattctcctcgctatccacctcaatcataggcgtaatctcagccttttcgatattgaccttggcaggacgatttttcttatattctgggacaaatggctgagctgcctctggtggtggtgccatttgagctagttgttcaagggccgccaagttttcttcattagcctgctggtaaatttctgcattttgcgcatggaaaatctccgcttgttgctgcgtcatttcctgacagacttggatgtccaccgcaagattaccaaaaccaaatcgcttgtattgctccacaagatttggcagatgattcttccgaaaatgatctgtgtcaatggtttcaggaccttttatccacaaaacaccatctctataagccacctctaatggctgaaaaagggccttgaagcctgcactctggcacaaatcttccgtaaaagcttctggataatatgcttctaccaaaccagcttcaaaagcctccgcatcgctgacaatagaaaattgaatcttattgcccaccttttcaaactccgtcgccaaacgagccttgaagagttgatagtccatgagcggcaagggggtttcaaaacggaaggtaaattcccaaagtttgctaaccttgtgcaagactactttctcaatcgttgcagtcgaaaaagcccctgattgtcgtgcatcaagaggcattccgatttgttgtagcaagagttgaaacttatctgacatacttatttcctttgtagttcgttagaaacattttaccataaatgaggtattttttcctgagtcaggaagaaaaaactctcaggttcatttcctgagagatctgatttctatagaaattggtagcctaccaagccgcagcttctgtcggtgcttctaaaaagtccagccattttcgatccttgacacgacagagggtgacagaaattcctcccatatcaagactggtcataaatttacctgtttttacataggaaagctgtaaaccttctagctctagaaattggcaaatgtcgttcaaaaagattccttgctcaacctcggacatagatccaagattattgaccagaagaatatagtcttccccttccttccagcggaattttaattttaatttgttcacaatttcgttggctaactgctcagaggattcaaaacgaacggtccgatagccttcttctccatggataccgataccgtaagatatttgtccctcctccaaatcaaacaaaggcagggcagcattgggcaaataggccgacttggttgcaaaaccgatggtcgcaatctctgttgccagagacagtcccagctgttccaattcatctaggctatagccagtaagggcagcagctcctaatatcttatgaagtagaatggtccctgcaagccccctatgccgcatacggaaattattcttagtatcgaccgaaatatcatcatgggatacaatgtacttgactgcaattccctcctgccgagccaattcgatggcttttctaaaagagataaggtctgcctcaaagttttttacaatcagaaaaactcccttgcccttatctactgcgcgaatggctgcaaatacttcttcagcggttgggggcgtaaatatttcaccatatactgcagcagtcagcataccctttccgacaaatccaatatgtgccggttcgtgccccgatccaccacctgaaataattggaactaaatggtcatcctgcactttctgaagcacaatcggaagtcccttcactttcttcactttaggattagttcgacagaaaccatccaaataatcttcaataattgttgcctgtctatttctaataaacaccatatattaactcctacaaaatcacaaacgactcgcgaacaagagccaccatttgcttccaataactgtgaatctgacaaggtgactgtgtcagtccttcctttatcagtccaatccaagcattagcatgatagagaatcaaaaaatgcttatcctgttgggaaatcattttaccctcctggagctggtactcgttgataattttctccatcaaaaccataaagtagccttctaaatagctgacaaaatcattttgccccttaatctcaaagagttgcctatagaaagattggttactctcgatgtagtacaacagctcatccagaagcttgattccactaatataggtcagattgtcagttacctgctcctgcaattctgtctcaaatatccagtccagcaactcatacttgtctaaaaaatggttgtaaaaggtttgacgacgaatccctgcttcctgcatgatgtcgacaactgagattttatcaaaggatttttgggatagctgttttttaaaagcctttgcaatccttttctttgtaatcaacgaggttggcatatgtcacttgtcacttcctttcgcttcctctttattataccctatcatgcttttctttggaacaaaagggacactttggacaatctgtcccttccttttttcttttggacaatgtaaaatgaaagcgcaaacaataacaaaggagttttctcatgaaaaaaattatcaatcaacccgaacatgtcgttgatgaaatgttaaaaggacttgtctttatgcaccaagatcttgtcgatcgtatcgatggatttgatgtgattatccgcaaggctgaaaaaactggtaaagtcggcatcatctcaggaggtggctctggtcacgaaccttctcatgcaggctttgtcggcaagggcatgttgtccgccgctgtatgtggcgcagtatttacctcaccaacaccagaccaaatcttagaagccatcaaggctgctgacgagggagctggcgtctttatggtcatcaaaaactactccggcgacatcatgaactttgagatggcacaagaattggcggaaatggagggcatcgaagtggccagtgtcatcgtggacgatgacatcgctgtggaaaatagtctctatacccaaggccgtcgtggtgtagctggtaccatccttgtccacaagattctcggtcacgctgcaacaactggcaaatctctagcagaaatcaaggaactggctgaccgtctcgtcccacaaatcaagactatcggcttagccctatcaggtgctacggtaccagaagtgggcaaaccaggcttcgtccttgaagaggatgaatttgaatacggtgtcggtatccatggtgaacctggctataagaaagaaaaactccaaccatctgctaaattggctgaagaattggttgagaaattggcagaaggctttgatattcaagatggcgaacactatggtgtccttatcaacggtctcggcgcaactcctctcatggaacaatatgtctttgccaacgacgttgctcaattgctggctaaaaaaggtgtggtcgttgactacaagaaaatcggtaactacatgacatcgattgatatggctggactgtcattgaccttaatcaaactagaagacccaagctggattgacgctttgcaggcccctgttgaagtggtagcttggtaggagaaagactatggatgcaaaacaagcattgctctggatggaaacattcaacaaaaaaattcaagaaaacaaagattatttgagtgagctagattctccaatcggagatggagatcacggaggcaacatggcgcgaggaatggctgccgtcatgcaggagctatctgaaaaagactatgagactgctgaccaagtctttaaggtggttgccatgcaacttctcagcaaggttggcggtgcttccggtcctctctacggctctgcctttatgggtattactaaagccagtcaagctggcgctgatttggcagatacgcttcaagcaggtttggacatgatccaaaaacgcggcaaggctgaattgggcgagaaaaccatggtagacgtgtggattcctgttatttctgccctaagagaaagccagctgacaacggaaattatccataaagccgttcaagggacaaaggatattgctgcgaccaagggacgcgcgtcctatgttggggaaaggtctattggacacattgatccaggctctttctcatctggacttctctttgaagccatgttggaggcaggactatgacaaaggttggtatcttactcgtatcccattcaaaaaatttggcccagggaatcatcgacctagtatctgaagtcgcaaaagatattcccatcacctactgtggcggactagaagatggtagcatcggtaccagctttgaaatcgtacaagagcgagttgaagcaaaccctgctgataccctccttgcctttttcgacctaggtagcgcccgaatgaacatggaacttgctgccgattttacagacaaacaaattcttatccaaaccgtaccagtcgtcgaaggttgctatactgccgcagctctcttacaggctggagctgacttggagactattcttgaacaattaaaagaactgacaatcaataaataggaggtcattatgaatctgattggagaattacttggaactttcatactagtattacttggaaacggtgtggttgcatcctgcatcctctctaaaaccaaggctgaaaatagcggctggctgaccatcgtactaggatggggcatcgctgtaacaattgccgtctacatatcaggaatttttggacctgcccacctaaatccagctgtcactatcgcaatggcatctatcggctccctaccatgggctcaagtcccaggcttcctacttgcccaatttgctggagcaatgttggcatccatcgtcctctatctccatttctacccacattggcaggaaacaaaagatagcggaacaatccttgctaccttctctactgcaccagctcttcgtcacacagcttcaaacttgctcggcgaagctcttggtacagctgtcttagtcatgggaatccttgcaattggtcctaacaatgtcagcgctggcctcggcccaatcatcgtgggacttatcgtatttgcaatcggcttctcactaggatcaacgacaggctacgcagtcaatcctgctcgtgatttaggccctcgtatcatgcatgccatcctacccattccaaataagggagattctgactggtcttatagctggatcccagttgctggcccaattcttggaggtgtcgcaggagctatcctctataacatcctactaaatatgttatagtcatttgaattaactttgatacatcgtcactttcggcttgccgtactatagtacagcctgcacctcagttccttgtctgaaagctaattcattcgactatataaaaaataggcttgggtgactagaaccactcccattttatcaacaaagacttggctatcatcaaccaagtctttttctgttattcattttcttttgtaaggatttgcaaggtttcaaggagttggtccacatggacttctacagtatcacctgtacccttgattttcacttcgacgatgccatcagctgctttcttaccaacagtcacacggattggcaagccaatcaagtcactgtcagaaaacttaacgccgacacgctcattacggtcgtcagttaatacttcatagcctgcaccaaccaaacttgcttcgatagactgagtcaattccatcgccgcttcatctttgacattgactggaatcaaatgcacatcaaacggtgccaattctttagggaagttgatcccccaagcgtaacggtattcgccttttggtgtcttgttaacaaagaggcgagcgtgttgttcaagaacggctgacaagagacggctaacaccgattccgtagcatcccatgataatcggcatagaacgaccattctcatccaagatgttggcattcatgctgtctgaatagcgtgtaccgagtttgaagatgtgaccaatctcgataccacgggcaaagttgagaaccccgtgtccatctggagaaggctcgccttccttgacttcgcgaatatccacatactcagtcacttggaaatcacgccctgcattggcacctgtgtagtggaaaccatcttcgttagcaccaactacagcgttcttcacatcttgaaccttacggtctgcaataatcttgatgttttctggtaaaccaactgggccaagagaaccaaagcctgcaccgaagactttctctgcatcagctgggcttgctacatcaaagaaatccgctgccaagtggtttttcaacttgacatcattgacctgatcattgccaacaaggagggcaacaactggctctccgtcagccataaagagcatggttttgatagtttgttcttccgcaacgttcaagaaggcagcaacttcgtcgatggttttggcatctggtgtagcaactttaaccaagtcttcttcaactacaactgctgtacttggtttgtattcgctagttgccatttctaggttggcagcgtagcctgattcgcttgagtaggcaatggtgtcttcaccagacacagaccaagccaagagttctgccttgaacgcttcaagaacatcctctgggatttcctcaaaagaagcaaccgacttgtccaagacaacccaacggtcgagatcggtacggtctggtgtaatagccataaactcctggctatccttaccacccatggcaccaccgtcaccgataatagccttgaactccaatcctgcacgagtgaagatcgcctcgtaagccgccttgtagtcatcgtaggtctggtccaagctctcataactagcatggaagctgtagccgtctttcatgataaactcacgaccacggagaagaccgttacgaggacgtttttcatcacggtattttggctggatttggtagatgttaagcggcaactgcttgtaagactggaccgcatcacgcgccaatagcgtcaccgtttcttcgtgggttggacccaagataaagtcagaaccttcacggtttttgagcttgtagaggtcgtcaccgtaggtttcataacgacctgactcacgccaaatatccgcggacaagagggctggtgccaaaaattcaatggcatcaatcttatcaaactcctcacgcatgatattttttgctttttcaatcacacggttagccaaaggcaagtagctgtaaataccagcagaaatctgacggacatagcccgcacgtaacatcaaagcgtggctaattaccgacgcatccgaaggcatctcccgcaaagtagggataatcattttagactgtttcatagttaagatataagtgcgttaagaaaacgaaacgaaaataggaaacctaacgcagtgcctttggcactaggcaggtttatctttttcgtaaagtttttagcacgcattcaattcctttcatcttttgtttatcaggaatgcacaggtttcagcccgtgttcagttcctttcttagttttcagaatatcctgcgttcagcacgcattcaattcctttcgtatttttcagaatatcctgcgtttagcacgcattcaattcctttcataaatttcaaattatcttagaagaagactcttataatatcattccaagtgactactatcataagaaccaccataacggctacacctgctagagtgatataagattccgtctctggtttgagtggttttctgcgaatggcttccagaatattcataacaatcttaccaccatccaaggctggaattggaatcaaattgaagattccaaggttaatggagagcgcagccattagccccaatacagaaaccaaaccaaattcagctgcttgagaacttactttataaatagcaaccggtccccccaactgcttaacatcaaagtttgcaattagattcttcaaagctgttacaaccctaagagctgtcgctcccgcttcttggaaaccaccgacaattttatcaacgaaaccagttttcaaaatcggtgaaataccaattcgataggccccatctacttgttcagcagtaacggagacatgacggtttttcccatcatgctcaacgaccaaatcaaagcttggggctgttgttgcatctgttgctgctttactaataatcgttgcaacttctgtgtagctgtctgtcgtgttcccattgaccgaaagaatcttgtcccctgtgacaacacctgcagcctgcaaagcaccaccttcagtaatacttactgcattgcttgatgggttggcaacccctccttgcatgaagaacaaaagaataaatactagaatccctaaaataaagttattcatgggacccgcaaagttggtcatcaaccgtccccagactgtcgcattttgatattgaacatcaagtggagcaatccgaacttctgttccatcttcctctacaatcgtggcatcgtgatcaaccttataggtcttgctttcttccaagaccaagcctgtgatttccaatttttcctcgaagtcaaaactggttacattcattggcaaactgagactatccagttgcttaccagacaaattaatccgcgtcacaacaccagcttcattcaggctgaggctggcaggactacctgtcttaatctctgtcttatcttcaccccatccagccattcgaacatagccacctaggggaaggatacggatggtgtaaagtgtcccatccttacctgtatgagcgaaaattttgggacccatcccaatcgcaaattccctcacaaggataccagctttcttggcgaagtagaaatgaccaaattcatggacaaccacaatcacaccaaatataaatataaatgctaaaattcccttcatagtacctccttaaaataatccaaagaagtgcatgattggaaagacaaaaatcataccgtcaaaacgatccaggataccaccgtgtcctggaataatttttccagaatccttcacaccaaaatggcgtttaatagcactttctactaagtctccgaattgtgagaatatcgagaaaatcacaaccaacaacaacatcatgccaaatgaatagcccgctaacaaggacttatcgacaatcaagaaaatgatagcaactaccaccgcagaaagaataccgcctacaaagccttcaaccgttttattcggtgaaaccttcggcaataattttctccgaccaatctgacgaccgattaagtaggcaccaatgtctgttgcccagactagacagagggcaaagaagactttattgagcccatccatacgagccagtatcaaactatgaaagccgataccaacatagaaacttgatgcaattggaaagacaacatcggaatagttgtaatgaccgatattaaaaaccgtcgaaccaagcagtaaaaatactacaatggcgtaggctgtgtaatttccatccgtcggtaaaaatgtcaaataattctggagcggaagagccaagactaaactggccaacatagctaagacaccctcgatagaatttggtgctaggcgatacattttaatcaattcagccgtagcaataatagctaacaggcctacaaaaaattgaaatgccatcccaccagccaacaaaaagggaatgaaaatagctagagcaatgccgccaaatatcactcgtttctgtaaatcgtttgtcataccttctccttatacaccgccaaaacgtctgtggcgacggttgtattctttaatcgctaatttaagtgcttctccatcaaaatcaggccaagcaatatctgtaaagtacagctcgctgtaggctgtttgccacggcaggaagttgctaagacgaagttcaccacttgtacggataactagatcgggatcgcgtaacgttggtgataaggttcctgtatagaggtaatccgctattaatttctcatcaatatctccaggattgaacttggcatccaagacatcttgcgcaatagccttgactgcgcgagtcacctcatcacgaccgccatagttaagagcgaaattgagaatcaaaccagtgttaccctttgtcttttgttcggctttataaagcgcattgagagtcgggacaggaagttttgaatggtcaccaatcatctgaattttgacattattggcatggagttcaggaacatacttatcataaaactccacaggtagattcatgataaacttcacttctttttccggtcgagaccagttttctgtagaaaaggcatagacagttaacacctttactcccaaatcagaagccgtcttggtaaccttttgcagtgcatccataccagccttatgccccataatacgtggctgcatccgctttttagcccaacggccattgccatccataatcacagcgatatgcttagggacttcaattgctgtttcaatgctttctttctttttaaaattaaatttaaacatggtattttccttattgtataatcgtttcattataccatatttttacctaggatagcaaaaatcaggcagggctaaaacaagagaaaaccaaggtttccctcggtttctcatccttattcttcaattgcagattctggagttgcttctgtcgtttcaactgccacttcttcaacaactgccgatgtagcatctgaacttgctacacgatcacgaatagcaccacgttcaaatgtcaagtaaacaccatcaacatcgagaacaaccttcttatcatcgatttcatcgacaataccaaatagcccaccaatggtcacaatttcatcaccttttttgatttgatttagtgcttcttgacgttgtttttgttgtttacgttgcgaatagaacataaaaccaatcatggcaaccatgacaagtggcaaaaataaaccttccatttgtttacctcttttattgtttgataagcatgattatatcaaattctggacaagaaagcaaagttcgaccaaacagaaaaagaccgaactttcgttcagtcttcgcacactattttgcgctccatacactctcaaggatgttggtctgttcacgaccaggtcctactgagaaggttgagatacgaacgcctaccaattcgctgatacgacgaacatagttgcgagccgcttctggcaattcatccaggctacgtacacctgtgatgtcttcagaccaacctggcatttcttcgtagattggtttgcaacgtttgagttgctccaaacttgctgggtagtggtcaatacgctcaccatccaagtcataagccacgcagattttcaaggtcccaagacctgacaagacgtcaatcgagttgagggacaagttggtaatacctgacacacggcggctatggcgcatcaccactgagtcaaaccaaccgacacggcgtggacggccagttgtcgtaccgtactctttaccgatttcgcggatacggtctccgatttcatcgtgcaattcagtcggaaatggtccgtcaccaacacggctagtgtaggccttacatacaccaacaaccttgtcaatcttgcttgggccgacaccgctaccgatcgtcacaccaccagcaactgggtttgaagaagtaacgaatggataggtaccttggtcaatatccaacataactccttgcgcaccttcaaacaagacacgcttgccttggtcgagggcatcgttcaaaataacagatgtgtctgttacatactttttgatttcttgaccgtaagcatagtattcttcaaagatttcgtcaaactcaatcggagttgactcatacatcttctcaaacaagcggtttttctcagccaagtttgttctcaaacgctccgcaaaaatctccttgtccaagaggtctgcaatacggataccaacacgcgcagccttgtccatgtaggctggaccgatacccttgttggttgtaccaatcttattctcacctttagactcttcttgcaactggtccaatttgatgtgataaggcaagatgacatgtgcgcggtctgaaatccgcaaattatctgttgtcacacctgaatcatggagatagttgatttccttcaccaaagattttggattgacaaccacaccattaccgattacagaaatcttttctgggaagaagattcctgacggaatcaagtgcaatttatacttcgtgccatcgataacgatagtgtgtccagcgttatcaccaccttgataacgtgcgattacttcagcattagcagacaagaagtctgtaattttacccttaccttcgtcgccccactgggttcctacaacaactactgatgtcatattcactctttctctgaactggctaaccagcccagcctttcttctacttctggcaggaatctcacctgcaagtttcgttttacacactattctatcaaaaaacgaacattttttcaagaaattccaataatttcatatatatcgaatgtttttatttttttaaaagtatattttaaaaaaatccgattaaacacacgaggtagacatgtgtaaatatgcttttggcagagaaatccgaagtctttgtttactttcagtgattttcagtacatttttcaccagaaacgtagcagaaatttgtatttgctctccaatctagataaaattggaataagactttgacagaaatataaaggacttagatatgttacaaaaattatcaccaaacagccccattcttcaggctacttttggaattgagcgcgaatcacttcgcatcaattcaaaccacagagttgcacaaactccccatcctcataaactgggttctcgtagcttccacccctatatccagacagactacagcgagccacagttagagttgattacaccaatcgctcagtcgactaaggaagcgcgtcgcctactgggagccattacagatgttgccgcacgttctatggataagcaagaatacctctggcccctatccatgccacctgtgatttcagaagaggaaatccaaattgctcaactagacagcgactatgagtaccaatatcgtgtcggtttgggggaacgctatggcaagctcgtccagtctatgtctggcatccattataattttgaattaggaaaagacttaacccaacaactttttgaattaagcgaggaaacagattttatcgcattcaaaaataccctctacctcaaattagcacaaaacttcctcaactatcgttggctcttaacctacctatatggagcaagtagcctagccgaaaaaggattcctaaccacggaagtcggttgcgtccgttccattcgtaattccaagtacggctatgtcaactccgatgatgttcatatttccttttcttctctccaacagtacgtggccgacatcgaacaagctgtccaatctggtcaactatccgctgagaaggaattttactcttctgtccgactacgtggagcaaagactagccgtgactacctcagcaaggggatttcttatttagaattccgttccttcgacctgaacccctatgacccgcttgctattagtcaagaaacccttgatacagtccacctctttatcttatctcttctttggttagaccaactgacagatgttgataacaccttagcaaaagcagataaacttaacaatctcatcgccctcagtcacccacacacacctctacctaacgatgccgatgccacgccaatcttgacggccatgaaagccatagttctacactttggactggatgactactatggccaactcattgcacatgcggaggcagcacttcaagaccctcgtttgaccctttccggaaaaatagcagagcaagttgaagatgggtctctagagaagttcggtcagcagcagggacaagtctttcatgactatgcttggacagccccttacgccctcaagggctatgaaaacatggaactctccacccagatgattctctttgacgccattcagttgggcttgaatgtggagattttagatgaagaagaccagtttctcaaactctggcatggtaaccatgtcgagtacatcaaaaatggcaacatgacttcgaaggacaattacgtcattcctctagccatggccaacaaggtcgtgaccaagaagattttggaccaggctggttttccagtacctgcgggagctgaatttgcaaacaagacagatgccctgcggtattacggacaggtagccagctctgctattgttatcaaaccaaaatctaccaacttcggccttggcatctctatcttccaggagccagccagccttgcggactatgaaaaagccctggacatcgccttttcggaagatagccatgtgcttgtggaggaattcgtggcgggaaccgagtaccgtttcttcatccttgatggcaagtgcgaggctgtcctgctccgcgtcgcagccaatgtcgtgggggacggtagctcaaccatccgtgaattagtagagcaaaaaaaccaagatccactgcgagggcgtgaccaccgttcaccgctggagatcattaacttgggcgacatcgaactgcttatgttagaacagcagggctacacacccgatacagttttgccagagggcattcaagcctttctgcgtggcaattccaatatctcaacgggtggtgactccatcgatatgaccgaccagatggacgagtcctacaagcaactggccgccgatatggcaactgctatgggagcttgggcctgcggtgtggacttgattatccccgaccgcaccaagccagcaagcaagaacaagcccaactgcacctgcatcgaactcaactttaaccctgccatgtacctgcacacctatacttacgcaggacctggtcagagcattacgccgaagattttgaaaaaattatttccagagctatagttttccattttccttactttgttagtgcttacttcaaaggttcgtggaacttttgaaggctggggatagggcaaagcacgttcgcctcaatagctgcaggttgctgggagtgagaaagaactcgaccaagataaaaagagttcgtcaacaagttttcgttttaagttgttgagctgaaacagtctatccccagactgtttcactcccacccccgcacagctcaaactgtctgggagacagtttgaggttggagataaggcgaactctgttcgcatcagtcgtagaggccagatttggagtgtgaaactcgaattgctgagatttgcttcgcaaatcctatctccaacctttaacagtccactggactgttaaacccaatcaaccactgcgctgagatgttgacacgaactctgagtagtggtcctgggctttttgcccagcctcagttggaaataagacttgcctctctataaagtacggcaaagcgagttcaaacaaaccagtggattgtttgaagcgggaaatccagaaacggagttcctcttgcgccgaagtaaaaaaagtcaacaaaaggactatatatctgctttgcccttttgttccttcacaaaaactcccaactaatgttaaacaaaatgaatatggcaccaagaaaatcatttatatctcggtgctttttttgtgaaccaattcccatcacccaaccgatttgttcgttttttgtttcgttttccaatttatttttaccatttcatttgaatttttaaaaatatccgtattatatctaaaaaagtattccaaacgactcattttctgttaaactatatgtatataacaactgcagacgtttttatgacgtccatatataacaaaaaggagttttatatgaagattagaaaccgttctctcttctataccgtaggttctgtagcggtaacagccggactcttgcttagtcttgctacttcgcccataccatctgtgcacgctactgaagtggcgatagagaattatccgtcacttgcaataaccaagtcggaagtcacgatacaaggctatcttattgcaccacttaatagtagcggaactgcttttgacgccactaacaaaacaaatctagcccttggtgcaagcatggatactgcggcagccgacactatccctattcaactaaaagaacctcttcgtagccaattcaacctcgttaatcatcccgaactagtcggaaaattggttcgcatcacaggaactagcgatacatacatgaagcgagctgggatcaaaccagctacagcgattgaaatcgtagattcatcttctactaatgttcagccaccaacaagtgaaaatacagctaccaaaccaagtgaccttgtttctacaccgattgctactgttcgttccggagcacaaggaacagagtacacagtttctggtaaaattattagcctagtaaacggttggggaggaaatggtttttacctccagggttctgacggtgctggtatctatatctacccaggggctgccttgggctatcagcttggtgatacagtccaattaacaggaacattgggtgagtataaaggcgaactccaactaaccacagttagcaaccacaaggctatctctgagaatttcaacactcctattacagaaacaaacatcgctcagttagcaacgcaagcacaggcaacactagtttctctaaaaaacttgactgtcggagatattcaaagcgatagctatcaaaattctacctttaccgtaactgactccgaaggacaaactgttgatgtacgcttagatagccgaacaggcatcaaaacggcggatcttttgaaccggatcaacaagggagataagattaatctaaccgctattttatccacctataacggaaaaatacaattaaaaccatttgacctctctcattttgaagtcattgaaaaggcaacgacggaagcaggactaggaaagaccgaagctgtaacagtcggtcgcattcaaggtgcaagtcaccagtcacctctggtgaatcaatctgttatgcttaaaaatgtcgtagtaacctacgttacctctgccaataacttctacgtgcaagatgtcacaccagatggagacaccaaaacatctgacggcattaacatctttactgacaaattaaaaacaaatgtcaaggtaggagatcttgtcactatcgcaggacgagtagaagaataccagggcagagggtatgctgaacgtgacaaaacagacttaaccatcacacaaattcgagctactgaagtaactgtggatgggactgcacctgtaccatctcctatagtcctcggtcttgatcggactatcccagcagatattattgacaacgacggtttggctcaatttgatccagaacaagatgcgctcgatttctgggaatccgttgaaggcatggtggttgccgtggatgatgcaaaaatccttggcccactaaaaaacaaggaaatctatgtcactcctgccactagtcaacttcctttaaataatgttggaggcgtcaaccttcgccctgaagggaataataccaatatcattccacttcttttgaaaaatggaaaacaaatcgtcaaatcaggagactatttcatcggtcgtatcgctggaccagtcacctactcttacaccaattataaagtctatgtagatgatagcacccttccaaccttgcacgaaggagctacaaaaccagaaacaacaaccattatcccaaatgatgacaagctgactatcgcttcttataacattgaaaacttctctgctaatagtaagtcaacatcagacgctaaagtccaacgcattgccaaatcctttgtttcagacctacattctccagatgttatcggattgattgaagtgcaggacaacaacggtgctacaaacgacggcacaactgatgctagtaagagtgctgaacgcctgattgcagccattcaagcagccggcggaccaacctatacctatgtagacattgctcctgaaaacaacaaagacggcggacaagagggaggcaatattcgcgtcggcttcctctacaactcaaaacgtgtcagcctatctgacaaaccaatcggtaccgcaacacaggcagttgcatgggaaaacggcgaactcaatctcagcctaggccgaatcgacccaaccaaccctgcttgggcagctgtccgcaaaacacttgcagctgaattcgtcttcaaaggcgagaaagtcgttgtccttgccaaccatctcaactcaaaacgcggtgacaatggtctctacggaaaaatccaacctgtcagcttcaagtccgaagaaaaacgccacatactagcacaaactatcgctgactttacaaaagcaggcttagctcaaaatccaaatgctaatatcgttatgctaggcgacttcaatgactatgaatttactaaaaccatagaaattttagaagcaggaggaatggctaacctcgttagtcgtcacgatgcatccgatcgcttctcttacttctataacggaaataatcagtctcttgacaatatgctagtatcaactaacttgtttgagcgctatgcctttgatatggtccatgtcaattcagcctttatggaagaacatggcagagcttctgaccacgatccactattggtacaactggatgtgacaaaggcacaagaaccaactcaaccagaaccaagcgacaagcagacagatgactcaggaacagtcaataatagtgatgacaatggtacgaccaacaataacaagccaacaaatctttcaacttctaatcaaacagctgtaaatgctgatgaccgttctggcgctacagacaagagacaaacaaccgtgacccctactgccaacaacagtcaaaagaaaatccttccaaagacaggaggagaaacaagctttgtacttatcacaatcggtctcgtattcttgagcgcctgtcttgtcaaaaaacaaaaagaatcctaatcattttttgagcttgaaagcatgactttcaggctcatttttctactgctccacctccacttgtgctataattaaagttatggataaaattattaaaacactatcaaaaagtgggcatttccgtgcatttgtgctagatagcacagaaaccgtgaaaacagcccaagaaaaacacgacaccatggcgtcgtccaccgttgctctaggtcgcaccctcattgccaatcagattttggctgtcaatgaaaaaggcgacaccaaaatcaccctgaaaatcttggccagcggtgctgttggggctatcatctccgttgccaataccaaaggtcaggtcaagggctacattcaaaatcctgacttggactacaaacggacagcgactggcgaagtcatcgttgggccccttgtagggaacggacaattcctggttatcacagactacggaacaggtcatccttacaactccatgacacccttgatttctggtgaaatcggtgaggactttgcttatttcctgacagacagccaacagacaccatctgcggtgggactgaacgtgttgttggacgaagaagacaaggtcaaggtagctggcggcttcttgctccaagttttacctggagcgaccgaggttgaaattgcccgtttcgagaaacgcatccaagaaatgcctgccatttcaagcttgctggcttctgaaaaccacatagaagctctgctatccgccatttatggcgacgacgacttcaaacgcctgtcagaagaggaaatcggctttgtctgcgactgctctaaagaccgcttcctcgatgctctagccagcctaccaaaagcggacctgcaagagatgaaagaagaagacaagggcgtggacatcacctgtcaattctgccagacccattaccactttgacgaaaacgatttggaggaactcatcaatggctaatctcaatacccctttcatgattggtgatgtggaaatccccaatcgctgcgtgctggccccaatggccggcgtgaccaactcggccttccgcaccattgccaaggaaatgggagcgggactggtcgttatggaaatgatttctgaaaaaggccttctctacaacaacgagaaaaccctccacatgctccatatcgacgacaacgaataccctatgtctatccagcttttcggcggcgacgccgaaggactgaaacgggctgccgacttcatccagaagaacaccaaggctaatatcgtagatatcaacatgggttgccctgtcaacaaggttattaaaaacgaagctggtgccaagtggctcaaggatcccgacaagatctaccacatcatcaaggaagtaacctcggtcctcgatattcccctgaccgttaagatgcggaccggttggaacaataccgacctggcggtcgaaaatgccctggccgcagaaagtggcggtgtagctgccctggccatgcacggacggacccgcgagcagatgtacacaggaacagttgacctagagaccttgaccaaggtagctggcagcctgaccaagattcccttcatcgcaaacggcgacatccgcaatgtagaagatgcccgccagcgaatcgaggaagtcggtgccgacgctgtcatggtcggacggactgctatgggaaatccatacatcttcaaccaaatcaatcactatcttgaaacaggagaagtcctacccgacctctcctttgacgacaaactcaatgtcgccttcgaccacctgacccgattgaccaatcttaagggtgagtccattgccgtacgtgaattccgtggtcttgcccctcactacctccgtggttcagcaggcgctgccaaaatccgtggtgctgttgcccgagcagagactatcgagcaggtccaagaactctttgaccaagcacgagaagcctatcaggaacggattgctaaataatatagtcgaatgaattaactttgatacatcgtcactttcggcttgccgtactctagtacagcctgcacctcagttccttgtctgaaagctaattcattcgactatatcaaaacctccagtttgagctggaggtttctttatctttttatgaactttcttttaagcgataggtctttctgggtttgcgtttgggcaatcgttccactccaacttcttccacaaagtctccatacttggctaggaaattattgtggaggatttttttgtcgggtgagataagattgaccaagtctgtcgcagcgtagatgttaaagggctgctgcaggagattgagaaaggttggattccacttcatccgtccctgaatccgctggatagaggtcatgacaatctcgtaatggtcaaaggcaaaatcctctgccgtcaagacctgaccctcataagaacactgcgaagtcttgaaatccacatcgataacaatcggctcccgtccatctggacctggtttgaccaaatccaaggcctgactaggcaggtaaaccaagtgggcaatagtcatcatccagccccgcggatcccgctcagaatcggaaaccgttaggagttgctcgatatgattgcggggcaaatccagtcccgcttctttttttatctcacgctgacaggtctggtaggcatcctcacctctggcaataaagccaccgaccaaggacagcttgtgttgacaagggtgggcagcacgacgaatcagcaagagcttgattctcccctctacaaaactatagaccaccatatcagctgtcacgcttggtttttcaaatcgcggagcgtcctgctttttataccagtctaaaaattctgcctctgtcacatatttttcgtagtattccttgtctgatagaccagcaggcctagccatttcgagccacctgcccttcttttatggacttagaccattggtaccagccgacaagcgagttgatagtccaaacgaagtacataaccgacatttgcaggttaccactatctggaccaacccaccacaagtaaatggagaagacattggttgcaatccagaaaatccattgctcacggtagaggtaactttgcaggaattgtcctgtccagttggtgccatctgtaatagagtcacggaagggacgagctgatccaattgacttgtaaatcaagccaaaacttccccataccaagacagcgaagactaaccacttaacccagccccagagagtcagcttacgggcttcaaattctgttttctcttcttctgctgctccattgacacgggctgatagccagaaatacaagccaactggctgcatgacaatgaagaaaatcgctgtcatgacttccccatagaacatattttggtaagataagacaaaatagatgaggttactgataaagccaaagaaatagttacttgaccgtccttctgctaccaagataacacagataatccctgtccacgaggtaaacaagcccatccagtcctcactagcagaccatacatgtaagataacaggcacactagacaaaactagcaagtagagccactgacctagggtacgaccgaaaaatagtcccgcaatgattgcgtccagaactccgataactcccagttttttggctctatttgcgatagcagacatgttttctggtacctgcttcaaggaagcttgaaaacggtcgatgaatttggtaagttgttccataatgtcctcctaaaattcctgatagatagcatcgattagctcgatagccttggcataattttctgcataagacccaccgataaaggccagcgaagcctgcgggtgatttttagcaaccagttctttcaaatgttcggtaaaggcattgcgaatttctgcgtcagccattgtcatatcccgaaaaccgtcatccacataagagcctgtcggtagaacaaagataatcaggtcccatttttcattcttaaccgtatcagcacagagcgagtggaaagaactagaagtttcgccgatgtagtagtcgtagtaggcttccgtcacggtcgcgttggtgtccgcaatgaccagaccacgattggtatccgagtcaatcaggtctgaggtctggcgatactggcccgtcaagagatagttgtagtccttgcctgtcaactcatcatcacgcacattgtaacgttgctggtagtagcgggcatattccagcgaaacaggacaggaataataacgccccaaatcccgcactagcgtggttttaccatttgaagcagagccaaccaccaagatattcttagaaaaatgacggcggaaaggcttggcaatcatattccaatacttagccgactgctcgcggataagagtggctgaaatgccaaaatttcgctctgtaaaggaagccttgaaaccacgagaacgcaactcttcggcatattcctgctccgaaacgtagaagacgagctcttcgttctccttaatcgccaccaaggcctgcaaggcttctaaccaaggtgcccaaccttctggataagggggcattccctcctcgtctagcttaaagacggataccagaggctcgtcgttgaaggtttcgcggatatagcggaaacgtttctgcaaaccgagaccaatctgatgaccacggtcatttttatagcccgacacgatgacgaccgcccgatcgcattcccgcttggctcgttgaatcaggtcaatatgacccttgtgcatgggagcaaaggtcccaaaaataactgctactgcttgtttcataatctacctttttattgttttttatattttatatcctactcttttctcaaaccaaagtcaagagttttttatatttttttataaaaagatagcaagccgaaagaaaagcaggtctaacctgctttcacactatcaaacttcaactgctcggccttgacccctacttttaaggtcacaccagctggcagttctccacgtaagagcatttctgccaatggatcttccaacttggtttggaggaggcgacgaagtgggcgggcacccatttctggatcgtagccttctttggccaagagtttaagagcagaagcctgcaatttgagggtaatacccttgctggccgccacggcaatcaatggtttgaccatgaccttgaccacatcctgcatatctgcttctgtcaggctatggaagaccactttttcatcaatccggttaataaattcaggacgataggccttcttcaacgcctcaaaaatccgtttttcaacgtgttcctgactcttagacaaatcaagagccccaaacccaactgtcttatcatcacgtaaagcggttgcccctaagttagacgtcataatgatgaccgtattagagaaatcaaccttgcgaccttttctgtccgtcaagacaccgtcatccaagacctgcaaaagaacattgaaaatatctggatgtgctttctccacctcatcaaaaagtaggacagagtatggcttgttgcgaactttttctgtcagctcgcccccttcttcatagccaacatagcctggaggagcaccgttgaggcgactagccgcaaatttctccatatactcactcatatcaaaacgaatcaaggcagattcgtcatcaaagaggatctccgccaaggccttggccaattctgtcttaccgacacctgttggccccaagaacataaaggaaccaatcggtctgtgaccagtgcgaatgcctgactggttgcggcgaattgcccggctgacagctgaaatcgcctcttcctgcccgataacacgcttgtgcaattcctgttcaagattaaggtacttcttggcatctgtctgactcagtttggtgacaggaatacctgacaagcgactgagggttgccaaaatgtcttcttctgtgacttccaagctatagctagtcgcctgattttccgcctcttgagccttaagcaagagctgcgttaccgtcttgtatttcccagccatcaaggcttggtctaaagcggtcaatccaccttcttctacctgtcccttggcacgattttgaaccgtcgcactggcttcatccagcaaatcaatagccgaatctggcaaattcttactggtcagatagcgtttggcataggctaccgccgttaccaccgcctgatccgaaatggtcaccttgtggtgagcctcataggctggcttcaacccctgcaaaattgctacgctgtctgctacactcggttcctcaatggtcaccttggcaaatcgacgtactaaggcagcatctttttcaatatgcttctggtattcatcctgagtcgttgctccaactgtccgcaaagtcccacgggacagagcaggcttcaaaatattggcagcatccaggatcgagtcaatccctgaccccgatcccataatggtatggagttcatcaatgaagagaatcactcgaccatcttcttcaatatcgttgatgatattgttcatccgctcctcaaaatccccacggaaacgcgttcccgcaatgacattcatcaagtccaattccaagatccgcatattgacaagactagctggcacctctccattagcaatccgctgggctagacccagtgccagagctgttttcccaacacccgcatctccaaccaagacaggattgttcttggttttccgcgacaaaatctgaagcatacgggaaatttcctcatcccgtccgatgactggctccaactgacctgagcgggccaaagccgtcaaatcacgtgtatagtcttccaagccaccactttgtgactgggtcatgcccatcatattgccaaccgttgcctgcttgggcttgccacctttcgtcatggtgcggatagccttcagatgctccttggtaaagccagccttggcttccagatttttccgcaaatccagaaaacgaaccttatcatccgaatcctcaaagtgaaaaccgacctgatccagaatttgtgaggcagtcgaacgcttgtccaagagcattcccatgaaaatatgctccgttcctagccccttactcttgacaatctccgcaatcttctcggcaaagacctgcaattccttcacccgcttggacgatggaagaaagaaaaagctctctaactcttcatggtaacgccgccccatcaccatataaactgcacgttcatagtccaatacatccgcaggatattctgctaaaatagctcccgcaacggtatctggattgatgacaaaggctaacaacaagtgccaggtctccaaatagtcactactataacgctgtgcaatcaattgagcatcttcatagacaccctgtaaccctcttgaaatcttcattctaactactcctctttcctatccaatcgacgtaaaatttggtacatcatccgagcccgaatttcactagcctcgttccctaaaacctcatctgtactagtagccaacaagagattgccctcacgttccgtcatcaactgctcgtcaaagagcaactgcagaatgtccgcaaaaacagttgccgacaggctatcacccatattcttcagcaaatcatggactagctcatgcttgtccgaaaaggtaatccgcccaatgcgaatgtagccaccacccccccgcttgctctcgacaatataacctcgactggctgtaaaacgagttttgataacatagttaatctggctgggcaccacttcaaatcgactggccagctcgctccgacgcaactcggctacactgacctgatctaaaatcgctttgatatgttcttcgatataatccgacgtatttttcatcgccatactatcgcctctttctttgactatctttgaccattatactatttttatccactttttgaaagcgaaagcctcacttccacacaaacgtagccaatttttgaaatttgctctgctttcttctataataaaggaaaaaaaaggagaaccccatgaactttcaagactacatccaagattttaccagcgtaaacgtggagcaggcacagagccttctaactgccaatgagggagcggtcctcttcatcggccgtgcaacctgcccttactgcaaccgcttcgcaccaaaactccacaaggttgcccaagacaagcaagtgaccatccacttccttgactccagccaagtcagccctgaactccaggccctccgcgaccactaccaagtcccaactgttccaggcctcctggtcgctaaatctactggtgtccaagtccgctgcgattccagcatgacggaagatgagattgcggcttttattcaagactaatgctagacatttcctaccaagccaacaccttccacatctcttatcaaggaagaccactcggcaagattcacagcaaccaaaatccctaccaccagaccaatatctatctgcgactagatttggttgatttcgattgcaaaatagcaaagcagctcttccagtccctacagacttccttaggcggaaaacctcttcaagttatgctctcctctgcagagcaggaaagaatccatttccttaccacagctggctttgtctgcaagcggaaatgttatgagttcgaagtgaccaagcaagactatctcagtcaaacaggcacttccaacttaagcatagtcctcaaaggcaccgcaccttatcaaatagtctgtcagcaaatttttgaccactatcaaacagtccaccaagacatcaatccttggactgccagtcaagaagaatttgaaaaaggcttacctgatctggtttatacagactcagaaaattgtgccttcatagataccgatgaaattgcctacgtatgcggaaaagatgaacaaagctttggttccttcatccaagcagttatttgccaactatttgaacagtatgagcaaattagctttgaggctgatgactgcgatcctatcgccatgcatttagctgaccaattccgacaaccaaacaagcctagctgggatgcttacattttagaaatctaacaaaaagcaccgaccacaaggccggtgctttttaaggagattatgaaaaatatttaggattgataatagtataaccgaatcaagcatatccgacatccgccctaagaccgattttgccaaaaaagaactccctttcggaagttcttgtgattttgaatagtctatcagtttgcttttagtactaggaaacgagccgcaggctgtactgaagtacggcaaggcgagttaacgaagtaatgaaagataaaatgaagactagcaattatttaccaagagctgctgccattgtcgctgcaacttctgcttcaaagtcgtttgaagctttctcgataccttcacccacttcgaaacgagcaaattctacaactgaagcgttcactgagttcaagtaagcttcaactgttttgctgtcgtccatgatgtacacttgtgcaagaagtgtgtaagcttggtcaacttgagtgttgtcaagcaagaagcgatccattttacctgggatgattttatcccagattttttctggtttgccttctgctgctaattctgctttgatagcttcttcagctgctgcaatcacttcatcagtcaattgagcttttgaaccgtatttcaacaatggcaatgctggtttgttaaccattgcacggctttcgttgtcttgttcgatcttgtggttgatttgtgccaactcatctttaacgaattgctcatccaattcagtgtaagaaagaacagttggtttcatcgcagcgatgtgcattgagatttgttttgcaagagtttcgtcaccaccatcaacaactgagataacaccgatacggccgccgttatgttggtaagcaccaaatgcttgagcatctgttttttcaaccaaagcaaagcgacggaatgagattttctcaccgattgttgcagttgcgtttacgtatgcttcttcaagggtttcacctgaaggcatagccaatttaagagctgcttcgttgtcagctggtttaccttctgcaattactttagcagtagtgtttaccaattcaacgaattgagcatttttcgcaacgaagtctgtttcagcgttcacttcaacaactgctgctacgttaccatcaacgtaaacacctgtcaaaccttcagctgctacacggtcagctttcttagctgccttagccatacctttttcgcgaagcaattcgatcgctttttcgatatcaccgtcagtttcaaccaatgcttttttcgcgtccataacgccagcacctgatttttcacgcaattctttaacgagagctgctgtaatttctgccatgtctattctccttgtttgtatttataaaatagaggagcgggctcagccctgcccctctaggattgtttttgtgtctgataaataatgtagaatgtactcggactaaaaagctagaatttagatatatctaacgcttttcttaacgccttcgttacttattttccttctacaacttcaaccaattcttcgattgattctgtagatgctggctcagctgccaattcagcttcaactgctgctacactgtcttcaccttggttgccttcgatgatagcgtcagccattttagctgtaatcaatttaacagcgcggatagcgtcatcgttagctgggatgataacatcgatatcatctggatctgtgtttgtgtcaaccatcgctacaactgggatacccaatttcttagcttctttaacagcgatttgctctttgtgtggatcaacgacgaacattacatctggaatgcgtggcatgtcagcgataccgcccaagaatttttcaagacgagcacgttgtttgttcaacaatgctacttctttcttaggaagcacttcgaaagttccatcttcttccatacggttgatttctttcaaacgagcgatacgtttttggattgtaccccagtttgtaagagttccacccaaccaacggtggttgatgaagtattgaccagcgcggatagcttcgtctttaacagcttcagcagcttgttttttagtacctacgaacaagataactgcgtcgtttgctgcagcgtcacggatgaattcgtaagcttggtcagccaattttacagtttgttgcaagtcgataacgtggataccgttacgctctgtgaagatgtacttagccatcttaggattccagcgacgagtttggtgaccgaagtgtacaccagcctcaagaagttgtttcattgaaattactgccatgagtatttctccttttgttttttctcctctcccgaacttcgacttgcagcccaacctttcggcaacaagaccacaattggtccgggatgagtatttgttgtttagacaacttagtaagtataccaaagttttaggtgaaaatcaagcatttcagtacacaaatctctagattatgccaagctcatagatcgggatatgtctctctttatgttactacttttttattatttttaacttcatccattttactttctatttcttagaaatagaaaggaagtaacgcctatctggtgttacttcctcttagttgtatcccttagataaactgtgatacaatgtctctctatcataaatcaatctctatctcgtaactctcatcaatccataggatgtttgcatcatattttttcgcccttctaaaaaatcgagtattttcttctaaaacactttccatcgtacaccattcatcatctatacgattttctataaggcgtgcatgtttctttatgcttccaaagtgtttctgaatatagttttcactcatcacaagacagtaatatctgatatggtcaaggtaggctgttgcaaagtcgtttgcccaatcaaaagggatatagatcccttcaacaataaggttttgctcattttctatagcagttttaatcatttcacgaacaataggccatagatatgctgtaagtttatcatcttcttcgactgaaagtttagtattgccgctacgaattaaccccattttcaaatggtctattgataaataaggatagtgatatttttcaagtaatttttgagctagcacagtcttcccagtgtgagatgctcctgttattaaaacaatcatgattttctcctatctaagcgacaaagcatctatgttttatatgaaaatttgtaagaaacactgcttgtcatcctatctattttttaatctcttactcaatttattatatcatgttcccacattttttcagttaatctaatcaagtacctgagttatctttgcaatatactgtaaataaaaacaaccgttttagatggaatattcttcttggtttaatctttatttagcaaaaataaactctatcacctccaaatctttcttaaagaggtgcactattatcgtaattctgttcccttaacattccttgcagtaaaaatgaattcacttacccaaagtgtttcttaattctttttgctccactctttttctatcaaacaaagagagtggtactagccatcaatactcaaaaagtactcctatctttttcgtcgtattctcctatgttttcgcaactgttttatagatttgttatcagtcacaaacagtcactagatttttcttgactttcagcttttttttcggtagaatattctttgttatggcggtatagccaagtggtaaggcacggctctgcaaaagcttgatcgtcggttcaaatccgtctaccgccttttaatattctaaaaaacctaggaatcttcctaggttttttactattcttttcgcttcaaatttccgagggccatagctccaccaaatagacctaacaaagtacttataaagacacttcccaggctatccccagtttgaggcagtttcccactagtatccgccgctaatgcacctgtctctcctattccgcttctttcaaagaattctctgtgaggtacggacacttctattctctcgtcagaaattcctagtggctcctcatgttttgtaagtttccccaaatgctccacaccatcttctcttgtatcgccagttaacagcgcgatttcagtggatcctgtttgcggagcaagtgaattctcttcttttggcattggtatatgcgcttccgatttcagaataggaatgctaggggtttgatccttatctgatcgctccacatgaaggtctttttcaggaacctgctcagatacttccttgtcatttaaccgtaccttatatttcttcacaacagcatttccaaaactgtcactcaaatcaagtttgactgtatccccgtctttcagactatgtagctcatagcgaaaggctttttcattatttccatactgcctccagaagcctcctcgagctacaaaatcttcgttgatcttcaaggaccaataaattccattatccttggcgcttccggtaagtgtcaagtgcccatcagcatctgccaggaggactcctgcatactgattttcctcgtcttcatcttcttcactatccactacctgtctttccaatggtagcacctcattttccagctgtaaaacagggttttctgtatcaaccaacatctgatatttcttcgtgtaagtcaactcatctgcctcattgtacacacttatatccacaacatttccctcttcaatcagagtaactggataggtcaacttcccatcctcaaaatagcgtttttcaccaccattgatgcgcacagaatgagcttgttcggtttctgcttctatttcaaatgtaaatagataagtcccatcttcttgctttttgaagtcgaccaacccgctatctagctcacgaccaagactttctttattgaaacgaattgggtcaatcagccagttattgacagtaatcggaacttctgtttcctcctcctcatccagactctctggacttgtattgatacgaaggtcctttaatttatttcccttctcatctaccgcagttaacatgatggctctaggaaaatcagatttaaagaagtcttgctcaaaactgccgtcttcttttacatctatgattttccgctctcccttaccaatgtctagattggaatagtaaagtttgatgtccttaggaagactaacattatcactcactttccctttcaatgtaaaacgcccatttttaccaatctggataacctcttcatcctcttcatctttttcaatatcaagatcaatcgtcggcttttcattatctaccaaataattcaaggttttagtgtaaataaggttgccatccttatctttcaagattaattcaaaactatgacgtccatctgattgctctggaatctggagagatagttgaccattctcaagagagtaattcacagcctgagcatccaagttagcctgtacatcggaaacttgcgctgagacgttcgctttaatttctacagttttcttactgcgaattgccatcaaatcttccaaatttttaaactggattacaggcgccatcaaatctttttcaacagcaaccacattacccgctatatccatcacctcaacacggagatgatttttagcatcgagtggcagttccacttctttgagatggtaatgtagttgacctgcatcatctacaaccttttcaacaagaagatcttctccatttagattagctcgaacctcccaaactttattattatccttggctgtgacgaccagttctctatggctggatagacgattggtatcaatcgcgacaatctctggcttttgattatcaattttgactggcagataggtatactgataggccccattttctttattttttacccgcaatctaaagaaatattgtccttccggtgctggtatattttcatcattgcttgcatcgtacactttcccatcccaacggtgcaattctatcggagtacgaagcttggaatactccgatagactttcaaaataatctacatagcgaacacgagacagcatggttcctgtatcaattcgccttaaaacaggagcatcttctgtagcttcttttacaatatccaaatcatagttggtaatatccctcaatagcgcaaatcgaacaaaggcattcccaatctgactgtccgaatgctggttttgaattgcgatattgtctggattgagaggcgattgattatcttgaatcttttcacgcccaagttcaatatagcgcccagacttattgtgtttatagctagataaaactgaggtcagtttcaatttagaactggtttcccaagccggtgcatcaacaatcctttcttttgaccagtcaccaacaaagccaaaataaggtatgctgatgtcagactgcccctccgtcaatgatttgaagtaaatatacccttctgcaaactggtctttcgcttctcctgcatccaatttcaggcgaatggttctcttctcttttggacctagttgaatggattgctcagaaagatgaatactcgaccccttgatttctgtcgcatgaatctctttaactacttttccagaacgtcctattctatcaacaggaacatcttgactagtcaacactttcccagctgaaatagcaaagcttctttgttggtttcccagattttccaaggttacctcaaattctgtctcacgccctatttcttttaattccacccctccttttagacggtggtgaagaatcacatctgtttcaaaggctctatcaatctgcaacagaccagcaccttgttgtctcggagaattttccaaagcatgcccagatgaatctagaacatcaaccaaaggggtagcagtattcatcaaaatgattctcagcaaatccatcctagtcatgccttctggtggtgtcatttggcgaatccgtggcaataaaagtgcgctggcacccgccacaattggcgaagccatcgaagtccctgacatggagccataacgattgtcattcaaggttgcataaacatcctctcccggcgccacaatctctggcttcaattctaagttgaccgtaggtccccaactagaaaagcctgatacagtcggcacttcaatcaacttcttcattccaattgtaggtttaagaaccaaaccagtgttgccttgcgattggttggcaacttctaataatcgccttccatcttccccgctaagactaattccccagatagaggagtaggaaagcaaagtcttatcatctaccaacaactgatgggtcctataataatccttgttccatccctgatcagtatttatcacaataattccagcaacatccttgaatttcaaattacgaacagcatctttcaagtcaaacttatcttttttgataaccgctactttaccagccaaatcaagcccttgcacttcttcccaatgaccatttccagcatctacaaattcatattttccctctgtaagcgttgtatagccaataggatagtaaccaaaagactgtccattcagcataaattctcgttgaacaagatgggtatttctcgccgaaccaaccgcgataactgcgggagtcgctgctacaccaactgttgttgccgtatccacagctcctaaggcattatttgtatgcaggtcaaaggaggtgtctgaagaggaggcaccagcattaccaatagccgctgtaatgataattcccttttctgctgccctcttagcaatcgtgtagtaagcattccctggtagcccgctatcataataaccaacactcaagctgatgacatctgccccgtgtttgatagcatcttcaatagcagcataagcagcatcctccgtctcagctttataatttttagggtcatttgaaaaaatcttgtagactagcagttgtgcgttgggagcaatcccatcaactccctttttagacgcaacttcttcgtctgttgcatttccagccagagttcctgctatgtgcataccatgtggttcgtgggtatcatcgtagagattatcgttgccagatacataattatagccatggggaactttcaatgtgtatgtccctgtcgtagatggagtaatgtccttaattttaggaatgacaccatcatccaacctcatgtctttgtgcttaatatccaaaccggagtcaatgactgcaatcaccattccgcgaccatctgtctgatatttagaacttgcttttaaggcaccaaccagctgtttagcagtatgaagagtcggtcggatacggcgactctcttctaaagaggttaattcggtaattgccttcacatcagacaaactttctttccctacctctactgatgctcccgttaaaacctccttatactcatgaacaattttaacgccatcaattttctttaatttatccaatacaagatttcggttctcttcggaaaattgtaaaatatagcgccctgttgtcacctcttctggctcaagctgtgattcctgcgggattgtttgaggagcactagcttcttttccgctaatgtcttctttttcctttgactcatctgttgtcttaccagctgtagtttctatctcggtcgcagcttgatctgtgagaagacctgattcttcacccgcctctgtatctacaacttcttcgaccactccctcttcagcaactggttcatccacctgctccgttttaactggatcatctgataatggtccatcttcttttttctctaccgcagaattttgcctactatccatatctgttgcgaccgcaactgtagactccaatccttctccactagtatctgcttgaaccatcggaacacccgtgataaaaaatcctattgataccgatgccacaccgacacttaacttcttgatactaaagcgttgtttattctcaatctgagaccacttctgtttcataaaacctccgttttttaagtttaattaatttataagttaggtacacctaattctataaaatttttaaatctttggcaagttttttttgaattagccctcaaaaacaagaaaaagcacaggcttccctgcgctttaacaacttattacaactcagcaatctggcttaaattaacttcagcaatggtatcattaccaaacatagagataaccattttaaccttgttgttgtcgatttctgtaattttacctgtgtagtctgtgaaggcaccgtcgatgatacgaacagtgtcgccaactttgacatcaatatcaaattcttgaacggtttgtcccatagacaccaagatttgacgaatttcttcttccaaaagtggagttggttttgaacggttaccgtgtgaacccacgaaacctgtaacatttggcgtattacgaaccacaaaccaagcttcatcggtcataaccatctcaaccaaaacataaccagggaaacggttttcttccacttccttgacctcaccgttcttttcaacctgaacagtctgagttggaatttctacacggaggatgttttccaacatgttataagtatgggcacgttggagcaagttttccttcactttattttcatatcctgagtaggtctgcaaaacaaaccagcctttatcaaaactatcgtacattgttacttcctttctttggaaacacggaatttttagacgctaaaaaaagcccgaaggctttcgcttttccttattatatcacttccattttacaaatggcaagtattttctagaaaagattgatcaagctcatgattcctcgtgacaaaatcaagtcaaagaggtaaaccaccgctacgaaaaaggcagtatattccactacagacacgaaatccgtccagctctgcttacgagttggccaagacgtatcttttaaaatgcggataatgtctttgataaatttcatgcgtgactcctatctggtttccttgtgaacagtgtattgtccacagtgtttacaaaatttatttacttctaaccgtgttggcttgggattgctcgaaaggctgattgaatagtttcgagaaccacaaacagtacaggctaggcttgctttttttagtgccataaagccctccatccttttcattctaccatgtttttatggatttgacaactctccaaaccaagacgttatgttatcccacaaggtttttgctcgttctggtaactgggcatcgattagattttgtttggtttgctcaatcaagtttttcgcctgttctgaaatttcttgtacctgttcttgaccaaggcttgattcagtttgcgcagcttcatctggagctacttctacaataccattttgtgcataggcgttttctacttcgaacttacttcctgcagtatatggcaagattgaattggccacagtctggaagaccgacggagccttccagtagctactgctatctatataatgattttcatctgtctgctcaaaaccaacccactgactgatgaccaaatcaggtgtgtaggcaatatgccactgatcattgacgagattgacatcaaaactcgtttcggttgttcctgttttcccagcgatatgataattggccgtatctgctgtcactcccgtaccattggtataggtaccaagcatcattgctgtcatcttatctgcgacagcacggtcaatcaccttggtacttgtttctcgatgctctgctaaaacctttccactagccgtttcaatacgagtgatgaggtgggcatccttcatcacacccttattcgcaaaagtagcgtaggcctgggccatttgcagaggattggtctccactccagaaccaattgaaacacccaaaactttctcgacattttccatatcaagtccaaacttttgtccatactcgaaggctttgtcaatacccaaggtgttcactatataagctactggtaaattgtaagagagagccaaagcttgatacattggaatggtatcagaagtcgaataatcatagttatgcaaggtgtaatcgccgtaggtttctgtatggttatccagagccatatcaatcgaccagcccgccgctactgctggagcataggcaacaagaggcttgattgttgaaccaggactgcgcttggcttgtgtcgcaaagttgaaggtccgaaagaccgcatcctctgaactgttaactcgaccaaccaaggcgcgaactccaccagtcctaggatcaagagctacgctggcagcctgagcatgggtaccatcaaaacttgatgttgggaacatagtctcatcattaaaaatcacctgcatgctggcttgagaattttgatccatctctgtgtaaatcctatagccgttattaataatgtctgattctttcagtccgtatcgctcaatcgcctcagcaatcacagcatcaaaataggatggataggaataattgctttgtttccctgtataggtatctgaaagctgactggctaggtctacttggaaacctgcatctgcagtcgcctgatcaatataaccagcattgaccatattttgcaggactgtatcccgacgattaactgcattttctagagaataataaggattataaatctcaggtcccttgagcatacctgctatgacggccgcttgctcaagagtaagattactagctggaataccgaagtacttttggcttgcatcttccactccccagaccccgtttccaaagtaggcattgttgagatacatagtcaaaatttcttgcttgctgtactttttattgatttccagagccaaaaagaattctcgagcctttcgactgatggtctgatcctgagttagaaaggcattttttgccaattgctgggtaatagttgaaccacctccagaccgacctaacgtcaaggcagccaaaattgtacgctggtaattaatgcctgaatttttgtagaagctccgatcttctgtagcgataacggcattctctaaattatcagagatagcatccagctctacataggtccccttctgaccagacaatgtcccagcttccgcaccatctttatcgtaaataatcgttgtggcttttagcgcctgctgtaaatcaccaacattagctgtctttgcaaggaaaaatagatagccacctactgtaagaactgtcaggaccattaaaatgattaaaattttagtcagttgataacggcgccaaaatttacgaatcggctccggaatacgtgattttttctttggtttatcaatagagccacgatttcccctgtggcgacggctaggtcggtcttcatgatcaatttggaaatcttctggaacttcaatcggctgatgttgcaaatcgtccatactttacctctttctagtgaattttgtaccattatacaccatttcctaaaaactagcagaaaaaagcctgcgataacttgtgacaacatacagggaattttttccaaaaatatgataaaatagggtcattctgaacaaagaagaggattcctatgacacaagtatatgacattactatcatcggtggcggaccagtcggtctcttcgccgccttctacgcccatctccgtcaagccaaggtcaaaatcattgactcccttccccaactgggtggccagcctgccattctctatcctgagaaggccattttagacattccagcctttccaagcctgacgggacaggagttgaccgacaacctccttgcccagctggctccatttgacaccaccatctgcctcaatgaaaccctgactgctatcgaacctggggaaaccattaccctaacaaccaacaagggcaaccaccagaccaagaccctgattatcgctatgggtggcggggccttcaagcctcgtccgctggagattgatggtgctgacagctttgacaacgtccattaccacgtgtctaatatccagcagtatgccgacaaggacatcgtcgtcttgggtggtggtgactctgcggtcgactggtccctggcctttgaaaagatcgccaagaccacccagatcatccaccgccgcgataacttccgagcccttgagcacagcgtggaagagctcaagcagtccagcgtgaccattcacacaccttttatccctaaagggctttctggggaaaatggcagagcttctgccattgatttcgataaggtgaagagcgaggacaagctgaccctgtcttttgaccacctctttgtcaactacggtttcaaatcatctgtcggaacgctgaaagaatggggattggaactcaatcgccaccgcattgtcgtcaacagcaagcaagaaacctctgtccctggtatctatgccatcggtgactgttgcttctacgagggcaagattgacctgatcgcgactggactgggcgaagccccaaccgctgttaacaatgccatgaactacctcaatccaaacgaaaaagtgcaacccaagcactcaaccagcctataagatgaaaattgatattcgcattccccaagcctttcctcaactgactgtcaaggaagtcttggaagattattttctcattcccagaaaaattcgccactttctccgcaccaagaaacaggtccgtgtcaacggtgagctgattaactggcagtgcccgattaccgcaggcgacttgttagaattgacctttgaccaggaagattatcctgaaaaaagcattcctctgggacaggcggacttggtggaggaactctatcaagatgagcacctcattatcgtcaacaagcccgaaggcatgaaaacccacggcaatgatccgacagaaattgccctgctcaaccatgtgtctgcctatgtgggacagacttgctatgtggtccacagactcgatatggaaaccagcggagccattctcttcgccaaaaatccctttatcctgcccattctcaatcggctcttggaagacaaggtcatctaccgtgactacctagccctctgccaaggccagctaaaaatgactgactggactattaccgataagattggacgggaccggcatgaccgtagaaagcgagtggtcgacaaccgcaaggggcagacagctcttacccaggtccgcctcttgaagacccttggtaaaaatagtctagtttcctgtcgtctccaaacaggtcgtacacaccaaatccgagttcatttagcccaccacggtcacgctctaatcggcgacccgctttacagtcgagtagctccccctcgcctcatgctccacgcccaaaaactcagcctgacccacccgctgactttagaagaaatcagcgtggaggcgcggtcggagagttttgaaagaatagtaaaaaagagctgaaaaaccagctcttttttgcatgtatgttattcaaaaatatttcccaactcaacatccacgcgattttccttgacattgatgtcggtcacagcgagcagagacttgtagttagctacgctacggtcccctttttggttttctgcaaagacagccacgcctaccaaggttgagtcaaactcagacaagaggctaatcataccattgatggtgccaccatttttcaagaagtcatcgacgattaagacacggcttcctgccttcaaactacgcttagacaggaacatcttttcgatacggtcgctagatcctgacacatagttgacagaaactgttgaaccttctgtgattttcaaatcacgacgcacaatcacaaacggtacattaaggacattggcaacagcattggccaaagggacccccttagtcgcaactgtcatgaccgcatcaatcttctcatctttgaaagcatctgcaatgatacgaccgacatttttcaaaatatgtggtgtagacagcaagtcagatgaatagatataaccgcctggcaagatacgattactttcggccatctgatcacgaagggcctgtgcaatttcgacagactctgccttagagatcgatggagtaaaaacaactcctccactggcaccagtaatggtttcaatatgcccgatagagctttcctcaaaagcctttttaatgatggcaatatcctctgagatagatgacttggcagattcatacttttccgcaaaggtattcaaactagttaattcataagggtggttgatgaggtaattggaaatgacaaccatacgctcacttcttcttaatttcataaaatcatcctctttcacttttttctattatatcacaacaaactacaaaaagcgaacttttttgattgaaaagtccgtctttttcgtattttgtttatcgcttacatataccactttggaagatgatgattaaaatattcataccattcagaaatcttctgcgcttgcaacttcatcaatggaatttgttcggaatctacttgttctgcccaagaaagagcgcctagactatttactgttacataaagagccatgagtttccaaaattcctctggaatagcgccgtcaaaatagacatctacctgaccacgcgcaaaggctggagacaaatctgccgtgaaaatcaaacggttaaattcttcccaggggtctcctatgtcgtagcggtcaaagtctaaaattttcagtcttccatcctggccccgtagaaagttacctgtgtgaaaatctccatgatggtaggcaatcggtctcccttcaagcaagtgacggttggcctgaacaaaggctatcatggcttgaccatttggataggaatgactagctgcttggtaggcagctaatttattgtcaatcttagcctgataaaaactgttccagtcgcgcagactttgatcaatcggtagggcatgcaaggttcgcaaaaacttccctgactgacagcccaattcatataaggtttgttctgacagactggtagccaagtcattcatatcctgaccttccatccattcataaagggtgtagactgacaagtcatccgcccaaaaacttagtggctctgccacaggcaaacctagaccaaacaggttttcaactaactgaaactctaattgcttagcctcataggctggccgctctgctattctcaaaagaccaaggcgaccatcttctagctggaccttgtacttttggtccgtggaccagcctttggtgaggggctgtcgagacactatcctaactgccatcagtcgatattgggcttatagaaggcgcgattatccatggcaaagatgcggttggtcatctcgcctgggccgaccttgtccaaggccgatagcatcatcatcatttccgcatcaatgttgtcaatcatgtggaggatttccgcctccataatctgcggacggacagggcttccatactccaagagcccatggtgactgaggataacgtggcgcagaacagtcacttcctccagactgtcatcgatgcccaattccatcaagaccttggtaatctcttcatcaatcaaggaaatgtgaccaatcagattgccacggacagtgtagccagtattgtctggaccagtcagttcgatcaccttggctaggtcatgaagcatgattcctgcaaagagcaggctcttgttgagctggggatagatgtcaccaattttatctgccaagcgtaccatggtcgctgtatggaaggacaagcctgagtagaaggcatggtgattggtcttggctgctggataggaatagaattccttgtcgtacttgctgtagagagcacggacgatccgctgccaagtggcattttcgatgcggaaaatcatctggctcaaatagtccttggtgtccttgacatccacaggtggtttttccttgaaatcagcagggtcgttgggctcgcctgcctttggcaaacgaagaaccagttgattgacctggggggtgttgttgtaaacctcacggcgcccctgcatgtgaacaacagttccagcagtaaaatccttgattttccctggttgggcatcccagatcttgccttcaatctcaccagtatcatcctggaaggtcagagctaggtagtcttttccagcccgtgtttgtcggacttctgctgacttgattagatagaatccttcgaagaattcatcttttttcatttggttaattttcattatcttcctcatctaatggggacaggccaagcagccccttggtttggtcatcttcgtacaggtcaatggtacgaagactacgctcgatggcgttggtgcgagtggttaggagtttgtcaatattgctgctagcttgattgagctgtttctgggccttgaccaagaggtcagaaaacttgccaaattccagcttgacattgcccaagaccttggaaatatcatcggccgaccgttgaatgttaagggtcttaaagccgacggagagggaattgagcagggcagaaagggtagtgggtcctgctactacgatattttcctgacggcgaagctcatcaaagaaaatgggattgcggaccacttctgaatacagcccttcggttggcaagaacaagacgccaaagttggtggtttcaggcggattgaggtacttgctctgaatgtccttggcaaaacgtttgatagctgccaggagatttttgcgatggaggtcaatctggtccttatccccactttcgtaggcatcttccaagcgataatagtccgccagcggaaacttggaatcgattggcaagtagatatagtctccctcagtccgtcctggtagcttgaccgcatactccacacgctcactagagcctgaaactgtggcaaactctcgctcatattggctaggtgtcaaaatatcctcgataatctgtcccagctgcaattcacccatgatgccacgggttttggtgccagacagcaccttgttaagactacccacatcacgcgccaccgtctgcatttcacccagaccacgattgactgattccaactgcttagacaccgtttcaaaggaggcttgtaggcgggtttgcagggttttctccagcttttcctcaaccgtctgccgcatttcttccaggcgtttttcattggactcctgaatggcctgcaaacgaaggtcggtggcatctcgcgtttccaagtggctcttattcagctcttgacggatgtcggttagctgttggtaaagctccgtgcggagtctttccacctcctggtgaatggtctgctgctgtttgagagttgcattttctagttgatagctgagctggtcagacaagttgtctgctgtatcttcggcttgatcttgcaaaagcagggccaagctctgccattttccataaagaaaaaccaaggcaagcaagaccagtatcagcaaaataagtagtacaatatccatctaatccttgtccttactgtagatcaggaccacatagccctgatccagttgaatgtctatatccctatctataaattcgttagaagcatagcattttttgaaaaaataattgctggcatccagcgggtacttggcataacgaatggtcaggtggctttggtccgacggcataaaggaaatgtacttcataccagcaatcggcgaaatcctatgactgcctgcaggtcgaaaacggacgacgttctgactgtccaccaattcaatctgctccatataggctgccaagtcgggttctgcaaccagaaagagattgctcatcatgtggtccatgcgaccacccaaggctccgtatatgcgaacctgggcctgcggataggccttgaagatttcctttaaagccaactccaagtctgtatcatctttttcagcaggagcttgcagaaactgctctgccatctcccttatctgccccagctcctcagaggtcaccgagtcaaaatcaccgatagcccagtcaagaggcagggaatggtccagaagacgaagagagcctgcatctacccccacatagaggtcggcaggctcaggaaggcagtcaaaggaaccgcctgcaataacagcaatcttaatcattgagggcagctctcaatttggcaacgttggcatccaagtctcctttgaagagataggagccagccacaaagacattggcacccgcacttttggctgaatgaatagtcttatcgtcaatcccgccgtccacttcaatatcaaaggccaagcccttggcttcacggagtttgaccaaatctgcaatcttatccgcaacctctggaatgtaggcttgtccaccaaaacctgggttgaccgtcatgagaagcacctgatccaccaagttaagcacaggctcaatggtcacaagcggcgtacctggattgatgaccacacccaccttcataccagcagcacggattttctgcaaggttccatgcaagtgaaccgttgcttctgcatgaatggttaaaatatctgcgcctgcacgtgcaaaggtctcaatatgattttcaggattggacaccatgagatggcaatcaaaaaccagcttgctatgaggacgcatagccgcaaccacatccgccccaaagctgatatttggcacgaaatgaccatccatgacatcaatgtgcacatactccacacctgtcttttctagacgcttgagctctttttcaaaatttgcataatctgccgccaaaatagacggtgcaatcttaaaatgtgacatagagaaccaactttctatttgaattttttactgactttagtataggtttcacgctgattttggatttcgctgaggaattggagataattatcaaagcgactttgggaaatggcagagctggcaacagcttccttgaccgcacaatccggctcatgggtatgggtacaggtcctaaatttgcaatcctggctactttccgcaatctctgggaaacaatctgtcagagcctccgcctccttgacttcatagtctagggatgaaaaaccgggtgtatccgcaatttttccaccgaagacattgtagaagctgaccgcacgagtggtatggcgaccacgccccagactatctgaaatcgcccctgtttccaaggctaattctggcgcaatgcgattgagaagagtcgatttcccaacccctgtctgccccataaagaccgtcaccttgtcctgtaaaagaggcatcaattcctccaaactatagacaaaaggatagccaattttctcatagatagccttgaaggcatccatctccgtccgatcttctaccaagtccatcttagagatatagataatgggatccatatccttctgttcaaggagaactaggaaacgatccagtagattggcattaaaatcaggttccttggccgacatgataaccaccgcctgatcgatattgacgataggaggtcgaaccaaactatttttccgctcatgaatctttaatatatagccttctgagttttcctccgcagaaaagtccacaaaatcacccacgtagggcgtttgtcccttcttacgaaaatttcctctagctctggtttgataaatctgtccatccgcctcgacatagtaaaaacctgccaaggccttgataattcttccttgcaatgaagactcctttgtgtgtacttgttcctattataccaaatttcctaagaaaaaaggagcaggaaagaactcgaaccttaataaaagagcgcgtcacccgttccacgtttcaagttgttgagctgaaacagtctattcccagactgtttcaatcccacccccgcacagctcaaactgtctgggagacagtttgaggttggatataaagcgaactttgttcgcaacagtcgtaatggttagatttggagtgtaaaacacgaacgattctaccaatcaaccactgcgctgagatgttgacactaaccttatgaagtgagatggtcttttacccagactctgagattttacactttactctagtcatttcaaataaaaaatagtataataaaaagcaagcggaggtggtggaacggcagacacgcatgcttcaggcgcatgtgcccatcgggtgtgagggttcaaatcccttcctccgcatgataaatggagagaccccaagtcaaagttgatgacttgggggcatttttatatcttctcactcatactcaatgaaaatcaaaaacagactagctccaaaggttttgggaacctttggaggttggaaatagagcgaacgtagttcgtttctacttacgcagatagaaccctgttactattttgtttcaaaggaacaggctgggagtgggaaagaactcgaccattcatagaagagttcgtcttcccaccccccgcacagttgattaggtcagatttggagtgtaaaacacgaacaaatctgccaatcaatcactgcgctgagatgttgacactaattttgtgaagcggtgctgtgctttttgcccagcctcgctcatcaaatcaagtcaacaacgtctgattttgattttcgaagagtattaattgctctccccaatccgtaccaccccatcataacggctaaggacctcatcggacacgcggtgggaaatatgaatgagcgtcttatcagctagtgaggcaaggtaattttcaatcactgcataggtttcctgatccaaggcagacagactttcatccagcaacaagatatccttatcttgcagcaaggcacggatcaagagcaggcgttgcttttgtccaccagacagtccgctatcatcactaatttcctcgctcaaagaagcataacttgggaaacgactgtcaaggttcacggtcttaatgtgaaacatcagcctatcttctggaacctcccgtcccatggtcaagttatatagaaccgtatcatggaaaagggatccctcttgtggcagataggcaatcttgtcttgaatggcttggtaggataagtctgaaagagagatttgatcaacgtaaatatcccctgcttgcagttggctattcttggtcaaaataagagccaaggaagatttgccagaaccactttccccaagaattaaatacttcttgccacgctcaaacgctacggtcaggtcttcaaagacctgtttttcaccgacagcataactagccttgaccagttgaatactctggaaagctgaagctagttcctgtcccttcgtttcttgaccaaaagtagatagctcaaactcttgctttaatttcttaacggcatgcctgtccaaaaaggctgccgcaatgctattaatgggatccaccaactgctctgaaatggtcagaatagctgtcaagccaccgatggtcaaggcaccagaaaagacttgaaaaccaccgataaagataatcgaaagagtggtcagataaaagacaaaaccgactaagagccgcatggttactgtcgttcgagtggcctgattgaccttgtcattgactgcttgatagcgatcgttcagaccatctaaaacttgctgtctttggtggctatttttcacttgcaaataactcagaaagacatctgaaactcttgtattatagacctgctgactgtccgaaatcgcctcctgattgagccttctccgctttttaaacaaatagggaatcacaactggtaagaatgagatcagaatcaagaaaatagcggtcagaccatccaagctaagaagggccaaactggcaatgccaaaggtacaagcaccttgaaaaattgtaaagaaagcgtcgtaataatcttctttcaccgtctccaaatcattattgagctgagaaatataggcccctgccccctgctcaacaaactgcctaaaaggtaaatcaaaaattttcccaataaaggtcgcctgcaattggaaacctacttgattgagatagctgacattggcaatctgacgaatgtattcaaaaaccagcatgacaaggacagttaaccccatctgcacaaaataagacacaaaggcctgtctatctccagctgcaatagcatcaataatatagcgatattggtacagaaagccaacatttagcagggctactgcaaaaatacaagataaggttagccaaaaattcctctttttcatttcttctccaccattttatagatttcttcgcaaatatttctagttgataacccaaccgtctggagcaaaccttcccaatcatttattttccttacaatattctgttcgtgattttgcattgaatattcttcaaaattttgaagagagtaagaagaaaactcaccatccggaaagaatgtacacggcttaatatggccactctcattgattgtccattcaataacacctgctccgcaacgcattgtcccatctacaatgtcttcaaaatagttaaagcaattatcttcttcccatgtatgtatattaattctgctcccatactctctacttttttctataagcatctcataaaattcttctactttagagggacttaaaaaccaatctgatccgactaacttacctctacccaaatgactaaatagcccaaatctcaccgcttttacttggtttagtattaaaaattctataaaattatcaaattcgtcgataagactgtttcgaacaatattggtcactgaatagtctaaattctcattgtttagaaatcttattcctctaatcgttttatttaatgtatcctttccattggtaatttggtcgtttagaatcggattatgatgatataaagaaatttgaatgtagctcattcccttcaaataaattatacttttggaattaattaaatgaccagtggttgtcattgttacttcttgaaagttctccgtagcatattttgaaatctctttaaaatgaggatgtgccatcggctccccacccgttaactgtatttcataaacctttccttttaccctatctaaaaaatttattagctcttcatacttcaaaaaattcctgttaattggtccagcttccttaaaacagtgtgtacactgtaaatgacatttattcgttaattctataactattttcctagggtaaaatttcccaacttcaccataaatatgcttcggataaacagaaactcctttaacaataaactctttcttcaagaataattttaatgtatccaataatagcttttttatttttgtttcacattcccccgctatatcagagaagtaacctatcaaactttctacactacccgtttcgtttatctgttttaaaactaacgcttgatattcatttaataagtattgaccgtattttcctataaccatcaaatcttcaccaaagtaatggtagtagtaatcacaatttagcataaatttcattatcatattctccttaaaaatacgtaaatttatttaatggaatcaatacactattatgtttttaaaatacaataagtttaatcaacgaaacttgtagcgataataatataaaaaatctctgtcaactagactaattttactaatcgaaaaaccaaaaattaataccatccttttgtttgctgtgttctttttgttccacatccactgagggtttcaattttacttacttttaataattttgaagacaactttttaaattcaattacagacatattcttctccttttcttgtccaataaataaatttacgcattattaataataaattataaatataggacaacaaaatatgtcccttatacgcaaccactactcaataagtatcttttccaatatactttcataccaatctgctatattctggctatcgaccgctcgtaaaagtccaatacactttctcatctccaaaatagcattagaagttccggtattttgataatcataaaaagccttaccaaatttaaacaaaatgcgttcaaaaatttctgtctcgtcgaaaagcaaaccttcgatagtcttttcaagaaagattgcgtcgacaagttccttagtttgaacgctgactagataagcactaaggagaacttgagaaactaccaatcgatgttgtttcatttcacggtaaaactgtgtacgatgaattaactctctacaaaaaagcatcattgtttgatgacccaatttgtcaatcgtattcgcaaatagtaagatctcatagtagctccaattctcaactcgaaataagtaatccgttaaaaaggctgtatcttctttcgaaacaactattgtcttatctaagtttctcagtttataagcgattaaaatagcattcaaccgatgaaactccctacgagaatctctttctgcttttgctaattgttcagacaagattttctttatggttacaacatctctgatatagatggattgttttagttgttccaaaattctagtcagctcatcttttttgaaatcctgactggcatacacgaactcgtccacatccacattcatttctgccagcacaccaaataatttactaacagtaatgtcggattccccattttcaaaccgagaaagttgagaagtagaaatatgtcccttggcgacctccgccaaactcttcccctttccctctctgataaatttcaacgttttcccaaaacaactcatttccagacctccttttgtatataagggatttgtttaaagcataacttaatagatgttatcatgattttaaaataaatattatctatattcaacaatggggaatatcaatgaaacaaaattatctaattgcaaacattactatcgttttaattttacttattagtatcctaaaagacattccaccaatcattgttataaaataataatactcaacgaaaatcaaaagtagaccaccttcaactatcttccagatagttgaaggtggaaaatacaaaacaatgtttgcgtcttcaagccgacgatagaacactgttactttcttattttaaggtaacaggctgaaaagttttccattcatcaagactcttgacaacggataattttgatttttgaagtgtataaacacctttattataccactccttcccatatttgtgtccattttcacataaagaaaaaccaagccagctatctgacttggtcgtgattttattctgtcgtttcagtcgctactttgaaaaaatctttgtatttcaaaaggtatccttttcctgtagataggtcatattggaccagtttgagttcttctgcaactttcgcatctcgctcagcctgtcctactcggtccttatgaagtacttctgtcaagagggcatagtaaggactgaccttgttattggtcgtctccagcatcagtgcattcatgtcgctagagttaactagctcataattgtatttcgctgtatcaaaattgctccaaacgaaataatctgtcttatactgcgcacttgggtccgtcacgaaagctgactctggatacaaacctggcaaatggtccccgtaaaaaacaactgtcactttcttatccaaggtcttaagctggtctagaaaatcccttgttgcctgatccgtaaaggataggaggcgaacatagctggtcaagttttcattttcctcagccgtgaagccctcacccgatgctattatacctgcaggctctagagaattccactgaacatggttctgcatggtaatagccgacacaaagctggtatcggcagaacgtacctgatccaaaatcaagtcataggtcttcttgtcactgacaaaattcccctgataatcctcagccgtcacagtaagaggatacttggcactattgagagtgtagaattgctcaatccccagctgcttatagatagaatttcggttgtaactggtatcgtagtaaggatggatggcaatacgattatctgctggatagaggtcactgatacttggcaacttcttcatatttggcgccacatccagatagactgaagaaatggatgagctgtaattgtagaagggcagaccactatagacctgaaattcgatattagccgtaccaccaccatagtggtcactcttcatcaagccactggtagtctggctcatgatgtactcaatatttggaaggacattttgactaagggttacacctggaatccgacgcgggtcagccaaactctcactaagaatgtagataaccgtctggtcagtcaattgacctgtccgttctgcattgatttcctcagccaaggcggtatacttcttcacaatggccttcatggtcttctcagagtaattctcaggcatttccatactggtcttgctgagttgctgcaaccagaggaatgaaagagtgcgataacgagccacaaaggcgtagcccttccaatctacattccgccagttattaacctgagaaagaataggaatccagccagcaatcttatggtctttttcattgcgaattgcccagcccattcctaaaatcaaggatacgatgactgaaattcctgccagccttttccagatagaagcgacaatccttccttggaagtacttcttgtgaatacgtcggtagataaacacaaggaggactataaagacgagcgataccaagacaacacgtagactgataaagctgagaatcatccccaagttcccgacccatttgaaatcattgggggtcaatggctccgaacggtagcggaatttgagaaaattggccgtaaccaaaatgacgtttagactagcaatcacggcaacagataagatttggcggttgataactaggctaatgatgacattgaggaaaaagaggcaggcaatctggaagacaatagcccctggaaagagatgacgtgtgaaataagaaccagtcgctccagccatagaagcctgataaccaatatgcgatagcgtagccagtgccaaactgataaagagcatgctgtagacattggttcgattggccttaaactctacaaatgccttatgaagatagcgaagaaaaatgtaggtccctataaaatggataggtgcaaacaagggtgtctggctgaaaaactctatgtaagaacctttctcaaccaaactctcataatggctatctttccaataagatatagctagtggactgagagaaagtaagctggtcaagagcaaatagccatctggtaccaagtgattggctgaccactggcttaatttttctcgaattcccgtcttcttccgccataaaaatgccaacaatacaggaagagccaacatcaatagaagctcaaattgaaagagattattccggaaaatattccagggttgatacttcttggcattgagccgatagaccaggttgataagatatagaaaacctagaaaatagccgacatacttggcaaaggttttggtctttataaatttctcatatttatcaagcaagaccaatacataaaatgtaaaaataagataggcaatcaagggcaagggaataaaccagagtggaaaagatacatcactcagtaaaagggctcgccccatagccagcaagacggtcattaccatgaccagaataaattgcttggttgccttgagtttgatttgtttcatagcatttctctcttaggaaatatttgattttcggtagataaaggtataataaatcgaccaaagtatccagccagtcaaactgataaagataactggcaataaccaccattgttgcttataggagaggattagggtgttcttccctttttggctggtaaccgttggcacaccaatagtggaaagataataatccatcttccctaacctctttccattcaatgtcaattcactatctcggtaaataacaatcggtatttggatttcctctgattgatttgccgaccaacttatttttaagctatccccaaaaacttgcttattaaattgctggttaggtaaaataatctggtcacggtaacgatcataacgagatttagcctcatttaccgcacgaacattctcttctttttcagataacaccggcacatagtcgggagttgatttctgagccagttgaacaaactcacctaaattttttgaatgcaaggatgcacgtaattcttccgttgttccgtatagagtagtatgaagcatatcttgtaagaattctgctttgttgtactggtcattgactgcttgattatattgatcccaagtaaaaccaacaccaattatggtagataagattgtcaaccccaaaaacaactttttacgtacttcgtaatctgttaattgaagaccaacaatcgtcagaagtaaagcattagcatacaaaaagaatctaaagggaaattggattaaatccactaatccaatacctttaccagcaaatagttgccacggaaaaagatttgttgaaaaaataaaaaataccagaaaagttactgtcagacccctcaatatcaccgattgcttcttccattttttcagcataaaataaagagaggttgcaaaaatgattggtagagagtatggaaagtataagaaataagccttagaccaggtaactgttgactgaataaactttttgtttataaatggtgctgctaattcatttgttgcatttacatataataagggtaaccagatatttacagttaaaatcagaaaaactccaaccgaaaacagtacatctttcattacgttccatttgtcttgcgattttaaccaaccaattgaaaaaagaattgcataggctaagatgagaaacagagccgacagcatgtgtatctgcaacattaaccctacagctcctgccatcagaaaaataggaactttaccagtttttaggaatcgaactgctggaatcaaacaaagcggaaataaggccactccccaacttgaaaatccttgagctacccaccagtattgaacagagtaggtagtcgcgaaaaacatggataacccaacagatagagaatagagtactttcacttctcgcattagaaaataaagcgaagtggcactcaaaactcctaaaagaagattagacagtagttggtatcgataccaagttccggccaacaacagcaaggctccttgcaaataggctagatatggaccatatagagcattgacaatccttccagattgctgatagccatgcaagctcattatataagaaaaatctcctgacttaatttgtatagctgtatcataaaaacgattataatgaaaaacaatatcgtctcctgtcaccactgcttttgtcaaaatctgtggcaatagaagggtgagcgaaaaaagaaaaaatacagttactgcaacaatatctggatgctttttcagtaatttttttaacataagataccttcataaaaaaagagggaacccctctcttgtttttgtaagaacctgtactcagaagtgaagtgattatcaataagagatagtttttcgctaatcaaggcagttttattgagagaatactgactgtactttgaaaaaactaacgatgactagcttaaaaactatccttaagtagaagtgctgaactgtgaatacgggttcttactattctgctcatttgcagacaataattccttaaaatttatcaactcccagtataacaagctttccccccactgtcaacgaacaaggcaaacaggaaaacaattttccattaaaataaatattgattgcagatttctccgcaatcaatacttgcttataaaccaacttcctgaaggctgtcagacaaacgtgcgaagtcagccatggaaagtgcttcgccacgaacactggcttccagctctgccatgccaagtgcctgcgtcagcttgtccttgacttcttcggatttgccgaaatggttggtcaggttgttccacagggtcttgcggcgatgcacaaagctggccttggacactcggaagaaaaaatcttcgtctttgacgctcaccagaggttgctcgcggcggaccattttgagaatggcggagtccacgtttggtgcaggcacaaagacggtgcgaggcacgataaaggccaccttggcagtcatgtagtactggaccgcaatggacaggcttccgtaagccttggtgtttggctcagcagaaatgcggtcggccacctcccgctgcatcatgaccacgaactcgctgaagggaatcttgctctcaatcaggtgcatgaggatagaggtggtgatgtagtagggcaggttggccacgaccttgatgggcaaatcagggttcttaaagttctgaatctgggtctgcaggtcggtcttgaggatgtcttggttgaccacggtcacattgtcaaagcgacccaaggtgtccgccaaaatcggaatcaggcggtcgtcaatctcaaaagccaagacctcagcggcattctccgccaaaaactcggtcaaggccccgattccaggaccaatctcgatgacattgacatttcggtcaatctctgccgtgtccacaatcttctgtaaaatattggtatcagtcaaaaaattttgaccgaaggatttcttaaaggtaaacccgtggcgttcaaggacggcacgagtaacgtttttgtctgcaattctcatgtgtgttctttcttgttttttatttcgccatttcactcaatcgtgaaataacacttagttttctcatcgtcgctgtaatgtccagctgtttttctaaataattggtatttagttttttctttcgagcatctctcggaagatacatgtatagacattgacttcccagacgcaactcctcatcgccaaagtcttggtgcaataatttgtttaatttttcaccatttatctcatcattggtaaagaccaaatgaacacgagaaggatcatagccctcaccaaaagaattttcagcaactgcttgtgttaactccatctgatgtttgacaatgatcgctaactctgcacctattttttctttaatggtttgatggataagccgactgagttcttcatctaatatatctgtttcacaaacaacatttccgctttgaatataggtttggacagaagttaaaccagcttccgtcaaaatttccgccaagtaagacatcttgggaattttattcttgccaacaggggtaacacctcgaaggaggacgacttttttcatttgttaatccccctcacctataatgatcctttagcgacaggatgcacaaccgatcagcttccaccatataaatcaaccgattctccgcatcaattctccgagaccaggcaccttgataatcatacttcaaaggttctggtttggcaatgccttcaaaaggatgtcgctgcatatcctggataatcttattgattctcttcagtgttttcttatcctgaccctgccaataaagatagtcttcccaggcgtcgtctgtaaaatggattcccatgttagtccgcctctatcaggtttcgttcttgggtttgtcccgttttgactttagccataccacgtaggactttttgagacagataagtgttccgagcaacagcgagggtttcttgtaaactatcccactcactctttgagagtacaacaatatcttcctctggatttttattaaccacgaccaaaggttcaaactcgtcattgacctttttcatatagtcctttaagtgatttcgaaaatgggaatatacaatagcttccataagcaatacctctcatcatttctaggcttactatagcatagaaaaaaagagttgtcaaacttattgtacaactctttaacgattctccaccttccattcgccgtcttcaaaccagtaaaaattctccgtcagctgcggctgttcaaagatttccaacatggtttcaaaaccgtcagcaagttggagattcttcaattctgcacggtcaatccagaagacctcgccctcatcagaagattggataaaacctgaaaaataactggttttgtagcaaaataccagatagcgataatggtcagtaggatccgtccagttttgaatgccacagagttcgagattggataccgtcaagcccgtttcttccttgatttcacgaatgacggaggaaataattgactcatttggctcgacatggcccccagggaaagtcacaccaggccatttctttgaattcctatcctgaactaatacctgctgaccgtctgtaatcatgcacatattggttaggatgacttgctctgtcctactcatgctctctcacttcaacaacttcacataatcactcttggtcgcaaaaagatgaccaactcgaacttcatttttcactacgcgatagagggcgatgtagtcttttccaacgacatagcctcgggttagatgaggcgggtctatctgcttaccaaaacggttatcggcgttaaaaccacgttcaggaaaaatttgcaaactctccaatgcttcgacaatcatcccaattcgtcttttggcaatttcttctgagaactgttccgaaaaataggcgtaaataactgccaattccttctccactgctggagcaagtatcactgaataagactcaaattccatacttctctttgacactttctaggctgatcccgtgacctgcctcaatcgcctgttggttttcctggatttccttctgtaactgtaaaaacaactcttctctttccaactcttcttctgtcagaattggcaactcattttttacagcgatattttgcaagaagaggttaaaaccagcagtcaaatccagctggttcatagcaaatacttccttggctttttctaaaagtctggaatcagttttaaaatttacttgggcatctttatttatagttatcaatctagtccacctcctagttttctatattttaacacaaatagacaccgctagcaattttcaaaaaagcagaaatagtaatatttccgctctagattgcctatctccccaaatcatcaaaataatagagattcaaaaattcttcctcagtaactggacgttcaaaattgtaaaaccagcgatagacttccacggctagtccatcaaactctaccctgtcgtccatttcttgcacaccggcaatatgaaacaaacggctctgcttccaaataccatccgcattgacatagccatcttcaactaaaccaagcaaatagtctgctagtttgttcttatcaacctgctcatcctcccaaacaaggacatcagccggcagcaagtaggtcacttcttcataagatgaataattttcataagaaggttcaaactcgtttttaaccaagcacttaacagcgtagaccctatccatgatagctctccatagcctcctcaacctccgccaaacttatcccaaacaattccaatcgtttgaggagttgtttgccgttgcagtagccgatgcggagcttctctcccagatactccctccgcttgcgactgtcgccacccataagcaaccctagccgaatcagggtcttctggctaatatcaaagttattttcatcatcgtaatgaccacgtacgcctgctagggccttttccaagtcttcaaagctggcgtgctcaatgcccaaggaccgcccttttgttttggacttgggggcagcctcgtcccgctgtaaaaaagcgtgtttgaccgtgggaatggcctgcataatgatttttcgaatccgctcgccattgtagtctgggtcagtaaagataatcacgccacgcaggtcatggagtttctcgatgcgttccaagtcatcgtctgatatggcagagcctctggtttcgtaggtatccacctcgtaaaaccgcttcaagtttgccgtgtcgtccttgccttcaacaacgaggacttcttgtatcttaattttctgagtcaattctgaacaaactccttgcattctcgtaggtcgcagccgccacttcttcgaccgactggttgcgaagctgggccagcatatccaccacatatctggtgtagccggtgcgattttcccgaccacgcttgggaacaggcgccaggtagggtgcgtccgtttcgaccaggattttttctaagggcaatgcttgcgccgcttcctgaagttcaacggcttttttgaaggtcaccactcccgagaaggagatgtgcatgcccaggtccatgaaagcttgagcctcctccagagtgccagagaaggaatgcatgatgcctccacgcggaccgacgccgacttccttgatgatctggtaagtatcttccaaagcatcgcgagtatgaaccacaaagggcaaatccaactgcttggccagctccatctgtcgcttgaaaacacgagcctggatttccttatccgccgtcatccagtagtaatccagtccaatctctcccagggcaatgaccttgggatgctggagggctttgagcagatagttttccacttcctcgtcataagtgccagcctctgtgggatgccagcccagtgtcagataaatttcagggtgctggtcagcaagctccatagccttgtcaatggttgcacggtcaaaaccgaccacattgtggagggtgacccccatctccttggcaaagtctaattcttcttggacccgaccgtcaaactgctctacgttgaggtgggtatgggtatcaaaaatttgtatcatcgttccatcactttctttcctactattgtaacatatttcagaagattcttatgagaagaaaaaaaccagcagactcgagtttctgctggcttctcttttcatcttcttatgctactgtaagaactttacgtcccttacggcgacgagcagctaacacgcgacggccgtttttagttgccatacggctacggaaaccgtgtttacgcgcgcgacggattttacttggttgaaaagtacgtttcacgatgaatacctcctcttagattcttgtattcgtttagccggctagttttgatcagttactaaacataccaaactattttatataaattctgttcgtttgtcaagctattctgccatacttttaggaaagaatcagaaaatcattgaaaaaagaggactagcctctttttaatcatgatttccttcaatatctacaacgacatatcggttcggctcgctaccttctgaataacttgtcaaaccatccattttagagataatgcggtggataattttacgttcgctacttgacatcggatctgtatggtaggcttcctgctctgccaaaacacgttctgccaatttttgtgcgtagccttgaagaacctctgcgcggtgttctacataatcattcacattgattgtgatatagaaattacgctcataacggttgtataagaagttctgagccaaaagttgcaaggctttcaaaacttttccgtgataaccgataacacgacctggttcattggtatccacttgaatattgattgtacggcgattatgacttgtatcaatacgcgcctcaacatccatatcatccagaatttcttgtacataagctgtcacttccgaaacaacttgttcaatatcatactggggctcaatcttaatatctaaatcagcaaaattatctgcttgattttctgagatgacttcttgatttacgtcttccttagcagatgttgttgcatctgtagtagttagtaaatcctctgaaagaatttcaatccgacctgtttcttccaaaatcgttgtcgcttctttttcatttttcaagatctgcgctttaatatcatcatcaagcgtttgaccagacttttcaaattctttcaccgctgcaacaacttttcctaggtcaatcgtagcctctgaaacgctttttactggttcattgaggtcattaatttcacttggaacgccacgaactgctttctgattagccttaacaaccgttgtttcattgatgacatcaatatccacaatcgctggctttttaccgaaaccaaggaaaccttttttctcacgcgcaaccacagtaatatgtgctttttttcgaggaatattcagctctaccaagccattctggatggcctcttcaacacttgctcctgtaaatttcatcttctctctcctagttttcctatttctttttctgtgcttttttctgtgcccgtcggatttttgcctgacgctctttttcagcatcaattttcgcttgacgctctgctattattttaaacggattattgaacaccaaggtttgagcaacctgataggcatttgacactgtccaatacaaagccaccccactagcagctgccacagcaaagaaaaagatcatcacgggcatgacataggtcataattgtcatagccatattcttctcaattgctgatttattggtcaaccatgagctgaggaatgtaaacactgcagctagaatcggcaaaataaagaacggatccggctccccaagatttaaccaaaggaagtgacctactttcaaggcttcaacacgtgtcagagcttgaaagagggccaaaaggattggcatttgaataaagagcggaatcatggacgctctcatgctgacgccattctctttgtagagagcttgcgttgcttcataaagctgctggcgactttccatatccgttcctggatactccgcttgcaactttttcagctgaggttgaagctcctgcatcttccgtgaggaattcatctgtatttggaacaacggcaacagaagggttcgaattaaaatggtaaaaagtataataccgattccaatttgaccgttgatagataggaactgaataatgctggcaaaccagtaaattaatctatcccacgcatctgtagattgactggtcactggccctgttccgcaggctgttaaaacaattagagatgctaccagtagacctgcccatttaactttctttttcaatcacaacaccttcctggtatagtttagctagtttcaaaacatggatgaggttttgcttcatttcttgataggacaattcctctacaccttttcgagcaatgataacaaagtcatctgctaccagttgatgttggcattcaattaagatgtgacgaatcctgcgcttaatcttatttcgcatgacagcgtttcccaattttttgctgacagataaacctactcggaaatgcttttgctctttaggtaatcggtagacaacaaacctccgattggcgacattgtttccttttgtaaaaatgtcattaaaatctcgttcacgcttgacacgatagctttttttcaaactgccactccatctttcaaaattacttctattataccacaaaattcaaaaaagccaataaacataccgtttataggctttttgcgttctgaatttcctctttggcacttttcaactggtctgcaatcgattcaaaacctgtcccgccaagggaatttctacgactaacagcaactttggaggacaaggcatcataaatatctgcttgaataagaggcgaaatagcctgataggtctcaaatgatacatcctggagatagtgtcctgccttgctacactccaagaccagttttccaacaatctcatgcgcttggcggaagggcagacctttactagccaaataatcagccaactctgtagcatttgaaaagtccttctctgtcgattgagccatcctttccttatgaaccgtcatcgttttcagcatacccgccaaaatatcaattgaaatcaaaactgtttctgccgtgtcaaacatgccttccttgtcttcctgtaagtctttattataggttaaaggcagggatttcatgactgtcagtaggccaactaagttcccataaactctacctgttttcccccgaatcagctcagccatatctggatttttcttctgaggcatgatggaagaacctgttgaaaaggtatcggatagggtgacaaattggtattcatatgaacaccagttaatgatttcttcacacaaacgcgacatgtgcatcatgaggatactggcatttgacagaaattccaagataaaatcacggtcagacacagcatcaagagaattactatagggcttggcaaatcccatcaaatcagacgtcatctgacggtcaatcggaaaggtcgtccctgccaaggccgccgcaccaagtggggatacatttgtatgctgcatgttgaatgcaaagcgctcactgtctcggctgaacatgttgtaataggctaacaagtgctgagcaaaactaatgggctgggcatgttgcaagtgggtatagccgggcatgattgtttccacatgctcctgtgcaaggtctactaaaatctgacgtaggttggtcaatttgtctacaacttgaaagagtgtatccttcaaataaaggtgcatatccgtagccacttggtcgttacgagaacgagctgtatggagtttgcctgcaactgagcctattttctccgtcaatagactttcaatattcatgtgaatgtcttcgtttcgaatatcaaataccagcttgccagcctcatactcctctagcaattcttccagaccagcttgaatgacctgagcctcagcttgagagataatcctagtttgccccagcatcttgacatgggccagtgagccttgaatatcatacttggccaatttttggtcaaagcgaatggaggctccgaattcttcaacccattcctcaagactggcttcaaagcgacctccccataatttctttgcttccataggctcctactttctagctctttttatgaatttccgcattgaccttggttggcaatccccaaagcttgatgaaaccgactgccgcatcttgatcaaaggtatctgcactggtataggttgccaaatcttcgtcataaagggaatttggagatttccgagcaactactttggctgaccccttatacaatttcacttttgcggtgccattaacaactgcctgggtctgagcaagataggccttcaaggcatctgttgctggattgaaccacaaaccattgtaaatcaagttagagagttcatttgaaacaatcggtttgaaatgcgatacttcccgtaccagggtcaaatcttcaatttccttgtgggctgtcagaagggtaatagctcctgggcactcgtaaatttcccgtgacttgattccgactaaacgattttccacgtggtcaatccgacccacaccatgtttaccagcaatgacattgagtctttgaatgagattagcaagacttaacttttcaccatttacagcaacaggaatacctgctttaaactcaatatcgacatactcgggagtatctggtgcattttctggagaagtagtgatgccaaaagtatcttctggcgcttcattccatggattttccaagacaccacactcattggcacgaccccagaggttttggtcgactgagtaaggactgtccagatcggcaggaactggaacaccattttccttggcgaagatgatttcttcttcacgcgcccacttccattcacggacaggagccacgactttcaagcttggatccagggctgcaatggctacctcaaaccgcacctggtcatttcccttaccagtacagccgtgggcgatagtggttgctcctgtcttatgagccatttccaccaactttttggaaatcaagggacggctgagagccgataccagcggatatttttgctcatagtaggcatgggcttgtagggcaggcaaaacgtattcttgagcaaattcttctttcacatccaaaacatgcgattcaattgcaccgatggaaagggccttgtcatgaataaattcgagatttttcccttcaccaacatccatacaaaccgcaatgacatcatagtctttcttcaaccaagcaatcgcaactgaagtatcaagtccaccagaataggccaaaattaatttttcttttgtcataaactttctcatttctatatatattagcaaataaaacttagtgactattatagtgtatatttatacttttttgcaacatatttatgcaaattttcttaaaaaatgaataaatatcgtacatttccagaaaaatttccaaaaaaagctagagaatattctccagcttctaaaatatattcctcatcataactgattatggttgataaattttccgttcttttaaaattttccagaaataataagctaaactaaaatcaagcaatccatgaatagccgagccaacacccaccaagccaagcatcgttatccagtaggtagcagaagtttgttgccccgaagtaagcaccatcaccacaatatattctcctagaccatgcaggagattaagcccaattcctaatagtaaaaagcgcttagaatccatgagaatcggaaaacgcttgaccaagaccgcacctaaggtaaggaagaacaggtgcgtaagcgcccgaaatacaataacgattggaaaaccggcgaggaaaaagcctaaactagaacctaaagcaacaaaaatagcagtagctggtgaaataaacatggctataaacaaaggaatgtgactagcaagtgtataggatgctgggccaataatgattttaatcggcatcattaaaggtattaaaatggcaaatgcggttaaaattgcactaattgatagctgcttaactgaatttttagatgatagtgttaattgggacattaggcacctctctttctattggtttgattataaaacaaaaccttacaggtgtcaagacgcctgtaagatttattaattttctagtaaaatacctgcatgttttaaagctgctgaaagttcattataggcttgcacagatgggaaagagactgtatgtgtatgaactccttctgttaaattactcagtaacacaccttggtattgacctaaggcatccaaaaaatgatccctatcttctaaacttgcaatattcagcttgcctgataataagccgtaaatgggatgctcaatttcaacatctagtatttgagctccaccctctagcaagattgtcaattctttttctacctcttctggaccatgttgacaagctatctttcgaatgtaggctccttcagtagatggcaaagaagattggagtaagtaccctctcggagttgccaagacagcttctccctccgcacgaagcaaggctacatctccaacaattacttgtcgactcactccaaattctttcgccagataattagctgcaaggggataggggctttctcgtaaaagggataggattttcttacgtcgttctgttgctttcatacacattcctttcgtacacttttttccattatatcaaaattcctgtaaatcaacctttcctcaacccaaaaacggaaactgcagaacagtctccgttatcatctgctagtttagcaatgcttgaatagccgcaatgtccaaacgtttcatggtcatcacagccgcattgactgccttgaccttttctgggttagccgtatcgtatgcttccatcaaaatacgcggcacgatctgccaagaaatcccaaactggtccttggcccaaccgcaaatctccgcttctggaactgccgacactttttcataccagctctccgcttcttcctgactgtctacatagaccatgaatgagaaggcttcgttgaaagaagccacgccaccgtagccgtggtccataacaatcattttctgtccagcgacaagaagttccgcataattcagtttggcagcctcaacagcagcctccccttcaccgtagtaggaaagttgaccgacactagcctgagggagcttgtccttgtagtagtccaacataggctgggccaaaccgacctgttcctgcgagaagagcaggcagatgtcaaactgataaggcttgtccaagtccggtgcataagacagttgccaagacagaccaaagcggtcttccaaccagacatagtaagggctgaaaggatattctcccaaaggcatgagaatacgaccgccttctgacaaggcttggtacaaacgtgtcacttcatccttgtcggctacattgaccataagggacatggactcattgagcgtaaagtatggacccgcactaatagccgccaaggtcatatcccccagttgaaactgaatcaaatccgaatcaccagaaggcgtatccgtaatcgtgtaggtccagtcaacattgccaccaaagaggtccacataaaaagccaccgcttcttttgcctctgtatcataccagagatgaggaataataggttgcataaatttctccttttctttcgtctgcccattataccacacacttgtccgtacaagctcacaggaaaacttcctatgctataatagaaggatagaaaaggagcaagctatggaaatctggaatgcctacacagccgacggtcacttgaccgaccacaccctcacacgcggagaatccattcccgacggcctctaccacctagtcgtcgagtgcatcatccgccaccacgacggcagcaccctcttcatgaaacgcgacagcaccaaaccctcctaccctgactattatgaagcgacagcaggaggttcggctttgtttggagaaatagcagagcaggccattttgcgcgaagtccgcgaagagacaggcattgagctgacagctgaccaactacgccaccataaacactttgttgcccatgacgaccagtgcattttccactgctactgggctgaaaccgactgggacaaagttgctatccaactccaagccaacgaaaccagcaattatatctgggtgcaacaagaaaatttgaaagatttcctggaaacagagctagtcattccaaggcagaaagactatgtggagaggctgtttttagaaagctaaattcccctaacagacaaatccccgccgtcacaggacagcggggctccttttatttcaaacctgcaactaggtcagcaatatcggctggtcgggttcggcaacaacctccaactaccttggcacccagttcgtgccattcaagtgtgttgtccagaagagaatggctgtcgtctgccttttccttccaagtttgagtggctccatcatagacttccccagaattcggataggtgacaaatggtttatccgttttttctctcaactgactgagaaaggctggatagagcgagggagccgtacagttaagaccaaccgccaaaatctgctcactgctgttgaccagctctgctattttttcaatagacgttccgtcagaaatcgactgaccgtcttgtgaggtgaaactaatataggcttcagcctctggaaaatcctctgccagcaactctactaaggcttgtgcttcaagaacatttgggatggtttccaaggctaagagttcagcctcctgttctaagaggagttcaattctgcgacagtggaaatcttttaattctgacagactaatgttgccataatcgcctgtatattcagcaccgttcgccaaataggctgcgtagggacccacgtcacctgagatgagaggataggttcgttgtactttttcagcttcagacaattctgcccaaacctcatcacgcgcttccttggccaaatcaacggtcaagcgaatgagttcttcagcctctgcttgtgacaaaccaacttctgctaatccttcaaaggttgcctgataggttgaagtcgtgaccaagtctgctccggcacgaatataatccttgtggatatccttgatatactggggattctccaaaagatacttggctgaccagagcttacctgatacatcatgacctcgaaattccaattccgtcccaagagcaccgtgtaaaatgatgtattccttttgttctaatagttctttaaaacgacccatactagtttctccttaccacttcttgaagcggatgtagtgataaatatagcagccaatcatgaatggcacaccaaagtaaagaccggcacgctgagaaggatcccaaccgattccgatgatggaaataaccaacaaaacaaccgtaatccacggcaaggttggtgagaagggtgtcttgtattccaattcatcttcgctatgattcttcaaaaattcacgtcggaaaccgatttgtgccaatggaatggccaaccaagcaatcacaactgcaaaaccagcaatggaaaccagagcaaggaagatagtatcttctgcataaattgacgcaaccaaggcaatcacaacaccaatcatggacaagatcatgccacgcattggaacaccgtgtttattaatttttaccaattccttgctaatcatgccttcatttgccaaagaccaaagcatacggcttgaagcgtatagccctgatgtagaggccgataaaatagccgtcaagataataaagttcataatatctgcagcgtaaggaaaaccgattttatccaatacaagtacgaatggcgcttctgtcacacctgcttctgacataggaagtagggctgccaagactacaatggtcaagacgaagaagatgaccaagagaccgattgttgacttgatggcttgtggcacggctttcttaggattgtcagtctctccagcggcaattccgatcatttccacacctgaaaaggcatagttaaccgacagcataactgaaatcaacccaactaggccgttaggaagtaaaccttgggctgtaatattagtaaagagcggcgcagcattggttccctcaaatggcaaaataccaaaaatagctaaagtcccaagcacaataaaggctgctatggcatagaccttgatagacgagagtgcatcctccgccttggcaaaccaaccaacagaaagggtatttagcccaaagacaataactgcaaaaatcgtcgcaaaaatccaaatcggtacactaggaaaccagcgttgcataagctgtgctgctccaacgaactgagaagctagagcgactacccaacaaagccaatacatccaggccaccataaatcctgttccaggactgataaacttggtcgcataggtatgaaaagaacctgtgactggcatggctaccgaaagctcacccaaagaaaacataaccaaatagaccataacagctccgaaaagataggctgcaacagctccaaatggaccagcctgtgcaatggtatagcctgaactcaaaaacaatcctgtcccgataaccccgccgatggacaacatctgcaaatgacgactgttcatctcgcggttaaaggtcccttgattttcaaaattatgattttccataaactctcctaaattcttgtgattattctatcataccatggattttcaaaaactggttatatcgttttcaatccaggtgttatagcttcaaactatgacaaatccccaccgccatatgacagtggggattatttcattacaaactcttcaacatattgtcaatatgctggatggatttttcacggccgagcaggtaaatagtatttggcaactcaggtccatgcatttcgcctgaaacagcgatacggattggcatgaagaggtttttgcccttgatgcctgtttctttttgaacagccttgatttgtgggaagatgttatctggttggaaatcttcgtccgtcatggcttccaatttttccttgagggcgttgagaacagttggaaccgtttcgcctgccatgacttctttttcttctgcagtcaattctgggaaatcagagaagaaaaggtctgtcaaaccaacgatttcatccgcagatgacatctgtggcttgtaaagttccaccaatttttctgccttgtctgtcaaacgccccgcttcttccaagaatggcttagcaaggttgaaaatagtttctaaatcagcatttttgatgtactcattgctcatccagtccattttcttctggtcaaaggcagcgggtgacttgctgagacggttctcatcgaagagttggataaattgctcacgagagaagatttcctcttcaccacccgggttccaacccaaaagaccgataaagttgaagacagcctcaggcatgtaacctttacggcggtaatcttcgatgaactgaagggtgttagtatcacgtttagacaactttttacctgtttcagaattgataataagcgtcatgtgaccaaattctggcgcttcccaaccaagtgcttcatagaccatgagctgcttgggtgtgttggcaatgtggtcatccccacggataacgtgcgagattttcatgagataatcatcaatgaccacggcaaagttgtaggttgggtagccgtcacgtttctggataacccagtcaccaccgatgttgccaccttcaaactcgatctcacccttaactatgtcgttccacttgtagataccagcttcgttgacagccaagcggaccgttgggacaatgccagccgcctcacgctctgcgatgtaggcagttttttcatcctcagacataccaaggtattcgttgatgtagcgaggtgtttcgcccgcagcttcctgacgctcacgctccgccgccaactcttcttcggtcacataagacttgtaggccttgccttctgccaagagctgatcaacatacttttggtaaatatccaaacgctcagactgacggtagttctcatgggtttctggactctcatcccagtcaatacccaaccaacgcaggttttcaagttgagaacgctcgccgtcttccacatggcgcttgcggtctgtatcctcgatacgaatgaggaaagtaccgccatgatgacgggcaaaaagatagttaaacaatgctgtacgggcatttccgatatgcaaaagtcccgttggacttggtgcgtaacgcacacgaattggtttagtcatgtttctctcctgtaaaatttcaatcaagaacattatagcatagatatgcataagaaaacagaaaaatcagtctaaacagactgattttgaggtgttttttggttacgtgccagccagtagaagacatagaggactaacaaaccagttgcagctaggaaaagtccgctaatctgattgacagtcaagattaagaccaaacccgaaaccaacagtcgagtaaaggcttgacctagcataaaataggttgataccgctccgccaatggtcgccaactgctcctctggcatagaattgacaaacttagcgttaaacttaggtccactagctccagaactaattcccattgtagtaaggaagaagaaaataattggcagttgatgaagcaacattccgacaaaaacgccaagaagagagaaagtggctgccacttccagcgtcaccatgctggtatttttgaaaagggtaaagactaaggtcgagcccagaatatgtccgataaagaagatcagaatggtcagggcaagggttgtttcaacattgaggaagacgaggcctgggtcttcgctaatcagcaggaccagaataggatagagaatcgctccacaggcgttgataagagggttggtaatcaggaccaggcggaactcgggtatcttgcgcagctccacgattgcttgcttgaaagaagctagaatgcctggtcccttggtttttggctcagtctggttcggctgctccgctattttcaaaggctgctccgtcaggagtttgcgaaaggctggcgtcagcagctgcatgatgagaagggaggctaaaaaggtgccggcgttgagaaaggccaggttttggtaggagaggaggccgaccaagagggcagagagggcctgaaaggcgatgttgaggaggctggtcacggtctggcgaaaggccgagtactgctcccgctcttctttgggcgctacgcgtaatcccagaggtgtatagaggccgttttcatagaagccagcgaagtctgcaaagacattgaagctagctgccactacgacaatccagagggctggctcaaagcccatgcagaatccgaggatgaggtagagaaggacacgaaagagtaaggtcagcttgatggtgctgattttattgaccgtcttgtctgctagatagcccgtaaagagccccataaagctagggaagatttccgagaaggtcacgatcgccagagccagacgactgttgggcaccagtaaaacatagttcatcaatgccagataatagaccacatcgccaaaattggacaacatatccgcagtcagtacccataggtaagtagcatttttcaaaatctttttcatgataatccctttcttttgattaattttcagaatattctgattttttgtcctacagaggagcctggatagaccttcctctgcgattattcttttacatagagtaaatatttaatgtagaaaatgccatatcacccgtcaccaagagaatcttttcttttggctcagatgcgtagttgttagttgttgacatggcgctatccaactctacaaccgcttgccagtcagcaggcagatagagtgtgatatttgagaaggccgcatcgatatgaaaatctgccttattacccagaatcaccgcctgatcaaaatagactgtactagatccaaaggctacatccacactatcatggataaaattttcctcatggatgtatcgagtcgaggaaccaaaagctgtatcgcgtcccttatcgccaatcacccctgtgacaactccatgagccagtctgcgcttccttggtttaaaaattagtttcaagccaagacagagtaagacaagcgacagaaacatgttccaagtcccaaactccacccattcatagacagagttggcagctataaaagctaggccgaaacaaaagatactggcaagccaatccaactttaccaagcggtgaaaacctgtcacaaaggttaatacaaaccagacagtggtccaaaagggcattgccaaatgcaaacccaatgactccctcaacaagaccaaaaccgccagtcctataactgcagctccaattaataaacgtttcatcttcctacctcatttcctgtaacttttcttttaataaatgataataatgccgcgacacgtggacttccttgtgagtcttatagaaggaaatccgactggtgcccgagaaggacttatttagcgaatagactaacttgctattgacaatggttgacttagctaccctacaaaagtagatgggcaaatgctcctcaagttcatagagtttcatcttaacctcgtaggcatcatcgcctgtatgagcaaaaatcttggttccatccgtttcaaagaaaagtatgtcccccaatgaaagaaaatactcgctgctccccttgtaaaaaacaagcgagggacgactaacttgttgcaaagcttgctgaatctgttcaatctctggtcccagctggctggttcggataacaacttcaacctgatctaagctgtcatcaaattcaatcctaactttcatagctccctcctttttgatagctctattataccagttcgacatccaattacaagggcatttcagtaagtggcaaaattagacaggtaagtggtagaaataaactaagaaaagtcccttgcattacgcgagggactttatttttattatatgattttgaaaattgcagagtttttcttcttaaaaaatcgcatccagcaacgatgtgcttccaccaccaccatcaccacctgcaccgacaatatgattgccaatgacctgagcaaaggtctcaatgttcaaactctgtacatagatttctccataaccagtaaaggtattaacgattccttcacctgtaccgatagattggaggaaaccattttccatatggatattgtagtccaaatcacgactccaagcaaccacatgagcattgtcaatggtgatacttccaccatccaaagttagcttcttaatagaaccaaacgcattcgccaaaagtgtgccatggccctctgtagtcatcacaaagagtccaccctgaccaccaaagaaagctttcccaacactctggcgttccattttatactgggcagaaccgtcaagggcaaggaaggcaccatcatttagtcgatattgctctgcaccaagttccaaggcaataacctgacctggcgttgaaggcgcaagtgcaatttttccatcgtcactattggaaatggcttgcgtgataaacatagattcgcctgataccattgaccgaccgatggcccccatcaatttaccaaaacctgaaccaccacgcgcattgagcttggtattcaaggtcacactcggcgtatggtagaccatgctcccctgttgaatataagctgattcaccagcttccaaggcgatttccaccaaaggaaactgcatattactatcgatagtatatttcatccgattgtctgacatagttgactcctattttttacgaaaggtcctgttaaccacaggatagccataataaacctagaacaagctaaaataaaccaagtatcatttatctcttcatttgttctgttgtgataatacaattttatctcattcaaaaaaacttgtcaaggatttcccggtcattcagataaaatttacaggaaaaaccgaacttcctgagcattcctatataacttctgttatacgacccgtatccacatcataaaccgcaccagaaatttcaacgtcgtcaggtatgagcggagattgtttcaagagagcaatatcctcccgcacgctttcttcaatgtctgtaaaaggaagaaagtcctgaccagccacatccactcccaaatctcgcttgagttggactgcaaattcttcattggtaaaggtctgtgcaccgcagtctgtatggtggaggacaacgatttcccatgtaccgagctgctgctgggaaatgactagcgagcgaatcatgtcttctgtcacgcgcccacccgcattccgcagaatgtgagcatcccccagagccaagcctaaggcctgcgccacgtgaagccgtgagtccatacaggtcacgatagccaccttggtctttggacgaagaggcaaatggtaatcaccatgcaggtcaacataggccttgttggccttcataaagttttgaaaataagacataggacctccttgtctgatgagaatttctgaaattttcagaaataggttagacctagcttatcacattcccgactatttgtcgcaaaaagaggagcgactagctgtaactcccgaatgatttcatcagttgaatactttctgcaagacttcgccaatggtggtcacgccgataacggtgatttccttgggcaccttgatacctgtcagggaatttttgggggcatagaccttggtaaagcccaatttggcggcttcgttaatccgttgttcaatacgattgacgcggcggatttcccctgtcagaccgatttcgcccataaagcactcttgtgggttggttggcttgtccttgtaactggaagcaagggcaactgcgactgccaggtcaatagctggctcatccagtttgacaccgcctgctgatttgaggtaggcgtcttggttttggagcagcaggcctgcccgtttttccaaaaccgccataatcaagctagcacggttgaaatccagtcctgtcgtggtccgcttggcattgccaaacatagtcggcgtcaccagagcctgcacttccgcaaggattgggcgggtaccctccatggtcacgacaatagccgagccagtcgctccgtccagacgctcttccagaaagacctcacttggattgaggacttcgaccaagccctgcgactgcatttcaaaaatgccgatttcattggtggagccgaagcgatttttgaccgcccgcaagatacggaaggtgtgctgccgctcgccttcaaaatagagaacggtgtctaccatgtgctccaaggtccgcggtccagccaaggttccttccttggtcatgtggccgacgataaaggttgcgatattgttggtcttggcaatctgcatgagctcattggtcacttcacgtacctgactgacagagccttgcacgctggagatgtcaggactcataatggtctggatagagtcgataatcaggaaatctggcttgattttctcaatctcggtccgaatgctctgcatattggtctctgcatagagatagaactcgctgtcaatgtcgcccaagcgttccgctcgcaacttaatctgctgggcagactcttcccccgacacatagaggacggtgccaatggtagacagctgagtggatacttgcaggagcaaggtggacttgccaatccctggatcgccgccaatgagaactagactccccggtaccacaccgccaccgaggacgcggttgaactcctccatgttagtcttagtgcgagccacttgaatggatgacacttcattgagtttcatgggacgggtcttctcacctgtcaggctgacccgctcgttcttgacttcagcgacttccacttcctcgacaaagctagaccaggagccacagttggggcaacgacccaggtacttgggcgagtggtactcgcaggattgacagacaaaggttgtttttttcttagcgatggtcatttcctcctatagagtgtattctaggatttcgcagtaggctatagtttctttgggaacaaactggcgtatcagcataccgtgacagacgataacgattcggtcataggctttgtattttccaagggcctgtaaaaatcgctctctcatctccgcagcagtctcatagcgaacaggtgaagactcaggcaccgctccgctattttccaaaaataatcgatgagctaagacagcctcgtcttgactggcattttgccccgtcatatctggtcgccattcatgaaaaaagggctcgaccataagaggtagttgctgggcatgagcaatgtaggtcgcagtttccaaggcccgtgtgacgcttgaagcgacgactacttgagcttgggaaaagataggattactagcaatttcctgagctaaagtccgccccttttcagttaaaggagccaaatcccgtccaaaacctgcatacagccgaggattatcatgctggtcaaacatactgtagtcgggttcggaatgccgcacaaagagaatctgcatagtagtctatttccctgtcgatccaaatccgcccgtccgaacgccgtcggcctgatcaccgtcagccaagaggaagggggcaaaaacagcctgcacaatccgctcaccagcttccaccacgacggtttcctctgtgatgtttcgcatctgggcaaagatgtggccttcgttggctggattgccgtagtagtccccgtcgataaccccaaccgagttaatcaggaccagacccttcttgcgaggattggacgagcggtcgtagagatagaggacttcgtttgcctgcatataggcctttacacctgtcggcaccagcttaatctcgcctggctccaagctgacagtttctgcagctttcaggtcataacctgctgcatgagcggtctcacgttttggcaataagttttcatcagtaaactggctgaccagttcgaatccacggattttcatagtagtttcccttcaatttcttcatgcataatacatacgctctctattataatttattcgcaggctaaaagcaaaactccaacctagtggctggagttttcaactttattcaaacacaaactggttgtggtaaagttcggcgtagaagccatttagtttgagaagttggctgtggttgccttgctcgataacctttccatccttgaggacgatgatttcatccgcattgagaatggttttgaggcggtgggcaatgacgaagctagtccgtcctgcgataatggcctccatagccttttgaattttggcctccgttacggtatcaacgtttgaggttgcttcgtccaaaatcaagacttgtgggtctgtcaaaagcgtacgggcaatggaaatcaactgtttctgacctgttgagaagacattctcatcatcggtcacaaaggtttcatagccctctggcaagctcatgatgaagtcgtggatatgggtggcacgagctgcggtttccaccatttcctgcgaaatgctctcatcaccaaagcgaatattgtccgcaatagtacccgagaataacaccgactcctgcaagacgataccgaccttattccgcaagctatccaaatcatattcccgaatatcgcgaccatcaaaggccacactaccaccattgacatcgtagaagcggttaatcaagttcataatggtagtcttaccagatcccgtcggaccaacgaccgccaccatcttacccttaggagcagagatagacaccttgtccaagaccttctgacctggcaagtagccaaagtcgatgtccttaatttcaacaccttcttttaattcggtaaatagcggagcgttttgaggacgaacttcctcaggctcatcaaacatttcctgaatacgatgagctcctgtgaaagctagctgcaattctgcccagctggcagcaacctgcatgattggctggtaatactgttgcgagtattgaacaaaagtcaccaccagaccaagtgcggcagctgtttccagtgagctgtcattgagaacaatgctggaacctgcaaagataacaatggccgtattgaccaaactcataccattcataaatgggaagagaatcccaccaaacaagcgtcccttgaaagttgtgcgacgaacttcttcattgagctccaagaaaccatcaattgtctcttcctgcacaccttgtacaataatcgctttttgtccagaaattttctcgtccatgtaggcattgagtttagacaccgcagcctgttgcttatccgtatatttccgtgataggcggatgataacgaccaaggcaatcaaggcaactggcgtagaagcaatggtcaccaaggccaagcgagtatcctgacggaacatcatgatgaccataccaacataaagagcgatgttggtcaccacttgggtcaaggactggttgaaagcgttttggatattgtccaaatcactggtaaagcgagaaagtatatccccgtccttgtggctatcaaagaaggcaactgtcaagcgttccagtttgccaaacaagcccttacgcatacggttggtcgaatgagccacgatacgcgtgaagaggagagtgtaaatcaaggaagccacaaccgtcgccgcataggcaaagaaaagattgagcataaccccgttaaaatcagccatgtctggctgaaagtcagcctgaccagcttgattggccataaagtaagcctgcccgattttccccatctccgcaatggcatttccaaggaaaacaggtgtcttaacctgcaggtaggtcgctgccacaatggctagaaaaatcacagcaaaggacagtttatagcgtttaaaataaaaccagaaaaaacgtaacgtcttcatctattcctccctccctttctgtgtttcgtagatttcacggtaaacatcgttcgtcgctaccaactcagcgtgagttccttgtccaattagacggccttcgtcaagaaccaaaatcttatcagctttgacaacagaagaaatcttctgggcaacgatgacagtggttgtccccttcaaatcatggttgagagcctcttggaccagtttctcagacttggcatccagggcagaagtcgagtcatccaagaccaaaaccttaggctcaccaatcaccccacgagcaatggacatccgctgcttctggccaccagagaagttatttccacgttcttctacttggctctcataggtatcatccaagcggtcgataaattctttggcttgggcaatacctgcggcccgctccaagcgttgcaaatcagcaccaggtgccccttgacgcaggttgtccgcaatggttcccgagaagagaatagccttttgcaagacaatcgataccgtatcacgcagggtgttcttgctgacttctttcaagtcccgaccaccgatggacaccgttccttcttgcgggtcaaacaaacgcggaatcagttgagcaagagtggatttacccgcacctgttgcaccaaccacaccgaccatttgacctggctcaatctcaaatgagatatttttcaaagtcggctccgtatcgtgtggataggtaaagctaacattgtcaaaaacaatcttaccagtcaattcttcatccgccacatccttgaaggtcatagcaggttctgtatccaagacctcgctgatccgcttaatagaaatagcagcacgtgaagcctgcatccccatgaagctagtcatgataatggcaaacatgatttgcatgaggtaactcataaaggaagtaaagccaccgactgcctccaagttggtttccaacatcccggacaccaagtagagcgatgcaaaaatcgccatgtaagagataaacatcatcaagggttgcaagatagcaaaaccatagccgataaagaggttgaggtccaagagttcattggatactttcttgaacttggcatactgatttttttcctgtacaaaagacttaaccacacgaatcccacggaggttttccttagcaatactgttcatcttgtccatgagggactggaatttcccaaaacgtggtcccatttgccccatgacaactgccataatagccataatcaagaccaccatgagaataatcatccaccagagttctggcatggtccgcactgccatgataaaggctccgacaaacagcaatggaacccgcatcaacactgtaaagagcatcatgacaaggttctggatttgattgacatcgttagtcatccgaacaaccaggttccctgcgttaaactcttcgatattagcataagagaagctttggatcttccgaaaggtcttctcacgaatatctgcagataccccttgtgaaatttttgctgcagcaatggtattgacaagccctgccaaaagaccaattccagcaataatcagcagtaatttgcccacacgaacaatttcatccttgtcattggccaagactgctgtcaaaacatcctgcaaataactaggttgcatcaaggtcgttgctacgacaattgacgtcagcaagaccgatgccaaggcgtaccatttataacgtaaaatggcttctttaaacatgattcttctccttatagcgttgaatatttacttttaattgattgcccacctgtttaaccaagtcaaagtcctctttttgaatgccccaaaaaagtgaatggtgcatttcttcatgaaaagctttcaggtgacatatcttcccttgtcccttctctgtcaaaaccagctgtttgaagcgtttgtcaaccttagagggaaggacttggataaagccatttttctccattctcttgaccagattgctggcaaccgatttggaaatctttaattccgcttctatatcttttacaaaggtttcggcttccgaccgttccgcaatgaagcgcaaggcccagccctgtggaccagccaagtgctccacatcgtattcttttgcaatggtttcactaatttgttcaatctgattgagcaagttccgaaaatctgcaatagtatgtcccatgacagctcctttctacgaaaataattaccatgagaactattatagttctcttaagaactattgtcaattatttcgtttgctcttttctgaaaatattttgttatttcagcatcattacgcacttaaaacccataatatatataccgtataaattatataagattttatgtatcaattatggtataatatatctaaattacaccaactagaaaggattttttatgaccaaacaaaccattgccatcttgggacccggttcatggggcaccgccctaggacaagttctcaacgacaacggtcatactgtccgtatttggggaaatgtccctgaacaaatcgacgaaatcaataaagaacatacaaataagcgctatttcaaggatgttatcctagatgaaaacatcaaaggatataaggatttgagtgaagccttggacggtgttgacgcggttcttttcgttgtgccaaccaaggtaacacgcctagttgccaagcaagtcgcacaagctctcaaacacaaggtagttgtcatgcacgcttcaaaaggcttagagcctgatagtcacaagcgcttgtctgaggtactggaggaagaaattcctgctgaactccgttctgaaatcgtcgtggtttcagggccaagtcatgcagaagagactatcgtccgtgatttgaccttgatttctgcagcttcaaaagacttggaaacagccagctacgtccaaaatcttttcagcaaccactacttccgactttacacaaataatgatctcatcggcgtagaaacagcaggtgcccttaaaaatattattgctgtcggtgccggcgctttacacggacttggttatggtgataatgccaaggcagctattatcgctcgcggtttgacagaaatcacacgtctaggcgttgctatgggcgcaaatcctctgacttacagcggtctttctggtgttggtgatttaattgttaccggtacatctgtccactcccgcaactggagagctggagatcagctcggtcgcggtgaaaaactcgaagatgtagaacgcaatatggggatggtgattgaaggtatttcaacaactaaagcagcctatgaattggcacaggaattgggcgtttacatgcctattactcaagccatctacaaggtcatctaccaaggtgcaggtattgaagatgccatcaaagaaatcatgacgggtgaattccgacatgaaaatgaatggcattgatttttattaaacagaaaaaataaaattaaaaggattacatacttatgaaaaaagttagaaaagccgttatccctgcagcaggtttgggaacacgtttcttgcctgccactaaggctcttgccaaagaaatgttgccgattgttgataaaccaactattcaatttatcgttgaagaagctctacgatctggtatcgaagatattttggtggtcactggtaaatcaaaacgttctatcgaagaccactttgattcaaactttgaattggaatacaacctcaaagaaaaaggcaaaaatgatttgttgaaacttgttgatgagacaacaggcattcgactacacttcattcgtcaaagccatccacgtggacttggtgatgccgttcttcaagctaaagcatttgtcgggaacgagccatttgttgtcatgctgggcgatgacctcatggacatcacagatacaaaagctgtcccattgactaagcaactcatgaacgactatgaaaaaacacatgcttcaaccattgctgttatgcccgttcctcatgaagaagtttctgcatacggtgttatcgctccacaaggtgaaggtgtcaacggtctctatagtgtggaaacctttgtggaaaaaccaaaaccagaagacgctccttctgaccttgctattatcggacgctacttactcactcctgaaatctttgagattttagaaaaccaaaaaccaggtgccgggaacgagattcaattgacagatgctatcgatacactcaataaaacacaacgcgtgtttgctcgtgaattcaaaggcaaccgttacgatgttggggataagttcggtttcatgaaaacttctatcgactacgccctccaacaccctcaagtaaaagatgatttgaaacaatacttgatcgatcttggtaaaaaattagatacaaagaaaaactagcaagcgctagttttttcttatgtcaaataaaatatccctaataatagggcgatcagacccagatagccaatgaaactgaaaaaaatctgttttcctgtaaagagatctttttccacaagaggtggaaggaacatcacgaccaagcaacctccaacagctcctccaatatgtcctgccatactaatggttggattaaaaagtcccaagaccaagttcaatcctaaaaggaccatgtagcgttgaccaagaacctgtagataagggctgcgactaaatttcctcaaaagtgccatagccgcaaaaagaccaaagagcgaggtcgatgcacctgcaccaactacatctggtgtaaaaaagagaacaaaaagattgcccattatcccagacaagagatagaggagaaagaagcgccttgagccaaacagtccttctaattgataacccaaaccaagcaaagtaatgctgttaaagataaaatgctcccaaccaatgtggacaaagatgggggaaatcaaccgccacaactgagtcggatcataccgcacaacttgaccatacatgccaccaaattcaaaaattgtataggctgtagtggtctgcccaaatcgaaatacttgtatcaaaagaaaaacaagagccgtgactgccaacaagccattggtcacaggatagcgcttatcaaaaaagttcttcaaaaatcaacaactccttcactggaatatcaaaaacatctggttcgaaatcatagacttgaaagtctgccaaggtcgataccgtctccccctgataatctgctaggtagcgatcataaaaaccaccaccatagcccactcgaaaacccgcttgattccaagctaaaccaggcacatggagcaacttaaccacagacttatccacaggttgtgaataaataccaggttcccaaactccaaacctagatttcaccaaatcatcaggattatattctacaaaatccatacgtccttgtgaataggtcttagggatgaaaatctgcttgccgtccttttgagcctgttcaatcaggtaagaagtgtcaaactcatggggcatggaaaggtaggtcccaagcgactttgcaccctgataagtatcagaagcaaggaggcgttccgttaactgctgactccatcttgctcgctgactactagtcagatctttcaaactctgcaagacctcttgccgaatgctctttttatccacagaaactcctttcttttcagaaaaagactggaaaaccagtctagtttgctttcattttcaaaaaatcactcaacttatccacagcaaagggaagcacttcctccttgggactaaggcgaggattgtggaggggataaggcgtatccacacccagccagaacataacacccggcaccttgttgagcaggtagccgaagtcctcacccgtcatggcaggtggacagtcaatcatctccactccgtcaatgccatcaaagtaggtcatgagttcatccgccaactgaggattattttccacaggtagataaccgctaggattgagctcgatttccaagtctactccaaaggacagggcgattccctctgccacttcccgcacccgcttttgcaccagaagactcatgttctgggtcaaagcccgaatggtgccgtgcaaaaaagctgtttcagcaataacattattggtcgtgcccgcgtgcatggagccgaaggtgaccaccgctccctcaatcggatcaacgttacggctgaccaccgactgcacctgagtcacaaagtagctggctgccaccaaggcgtcatttgcggtatagggaaatgctgcgtgcccaccctttcctgtaaatcgtatcttgacttcacaggtcccagcaaagagggtcgcacggttggtggccatttgaccaactttgaggtccggtcggacatggagcccataaaattcatctggtaaccaatccccgaaagctcccgcttcatacataagcatgccacctgctagattttcctccgcaggctgaaacaagaagagaagattatttctcggctgctgctctgccattttctccaaaagccccaaggcaatggtcatgtggaaatcatgtccgcaggcgtgcatcctgtctgggtggagggacttgaagtccaggcccgtctcctccacgatcggcagaccgtcaatatccgcccgccagccaatcgttttctctggagcagagcctgtcagatagaccagaatccctgtcttccaagtgcggacttgggcaaaagaacagtcttgaagtaaaccttcaatagtttccataagaaaggcgtgggtcttgaactcctccatgcccagctctggaatctggtggagggcccggcgtgtcgcaatcaaatctagcatagctacctcttagagtgtccgcaaagcctcttccaaggctgttttttgttgggtttgagcgtcgatttccttgatgatgcgggctggcacacctgccaccactacgttttcaggaacatcttgagtcacaatggcacccgccgccactacagaaccgctaccgatttgcacgccctcgataacaacggcattggcaccgaccaaaacgttgtcgccgacacgaactggctcggcagaagctggctcgatgacacctgcaaggaccgcacctgcaccgatgtggctgtttttaccaacggtcgcacggccgcccaaaatcgcacccatatcaatcatggtacctggaccgatttccgcaccgatgttaatcaccgcgcccatcatgataacggcattatcgccaatggtcacttgatcgcggataatggcacctggctcgatacgggcattgatattacgcttgtccagcaaaggcacagccgaattgcggccgtcttgctccaccacatagtctacattttcagtcaagtttgccaagagtggctcgacatccttccagtcaccgaagaggacattgccaagctttgtcacttcagcagtaacagctcctgccaattctccttcaaaggtcactttaacagttgtcttcttcacagcattaccgataaaagcaatgatttcttgcgcagtcattttttgtgcagtcataatgtttccaatctaaaaataatattttttctattatatcaaaattttctgaaaatttgggaagaaatgcaaaaaaatgaaaaagggagtgggaaagaactcgattaggtcaaaaaagagttcgtcttcccaccctcgcacagttgattaggccagatttggagtgcaaaacacgaacaaatctgccaatcaaccactgcgctgagatgttgatacgaactctgagaagtgatcctgggctttttgcccagcctcctaaatactatagaactctctatcctcctaaagcagctgacatttgctctatctgctgttgcaaaccatctctatactctttcaagaatgtaataatctctgctcttccaacaattgcagcatttcctaatggaccatattgttttttctgttgctcaacagattgtgataccgtatcacgcacagactggtacatagtggcatcacccaatccatactggctgaccatattttcatagttcgtaatatattcattcacaatgaattcatacatcttcatataatcgctataagtttttatactttcaattgttgcatctgagctatctgtcggattaaattctgaaactgtagcagtactttctgaacttgttggggtttccgtagttttagaggaagattctactacctcatcactaatatctacgctatttaagatctgttcaaactcttgtttcctagtggaagaatagtcatcctttgacatataaattacatttaaaaatccctgttggagtgtcgactaaaaagagttgacctttatatgcttcgccatctatcgtacctgtcgcatcataaaggaagctgtccatcccatcaatcttagctgagctttcgttagctggtatcacttttcctgactgttccatccccttcagatattgggagcgaacagttgcatctttaactgattcctctaagggcaaccaatatgccattgccaatgatgaatcatcgggataaaaatataaggtatcactcgtatccccttctttactcttccatgattcatttatgctgatagccacttctgacaattggtaagttttgtatcttatagagcttgtacttacctgttctgtcgaagattggccaccgctagagctcgtaaggttcttaatcagaccaatcgcaaacaatccaaccaacacaataaaccaaattcgcttgtaaaatggtttcttttgcacatagacattcccatgttcatctctaattttcttcgccatataatcctccaaaaaattgtgtacaacaccattatatatatatgcgttgtcaagtagaaaaacaaaaaaattagaagttttacctcctaattttcatgtattatcttaatcttcaatttcttttctgggattgacagctcctacgatgtaatcctgtaccaagcctgtaccatccagcacgatcccatgcaaaactccgccgtaaacagctccaccgtcaatccccattttcccatctggactggtccagatttggctaatgcggagttttgtttgataaaggttataaacaggagtatgcccaaagacaatcatcttccctgtggtattttcggcctcatggaaaggggtgcgtaaccaaaccttatcatgattgctggtttcacgccagtctggtaaggtcaagtccacaccagcatggacaaagatataatcttccgtttccagatgatagggacaagatttgacgaaatcaatcaggtcctcatattgttccaacactgcattggcatccaccaatccatctacaggagcatccaagggccgaccaagaagggagttaatcgtcgtatcgccaccatttcgccgatagtggtcatagcggtcaatcggatcacgcaaccaggctagaaacattcgctcgtggttacccgtcagacaaattgcccccttttcccgcaccaagctccagaccaactccaaacaggctttggaattttctccgcgatcaatcaaatcacctaggaagatcaactgttgtcgcttctcgttccatttcttcaaaatatcgagtagcagttcaaactttccatggacatcgccgattacaaaaaattcttttttcatagactctattctaccacatttaataagcaaagaaaaactgaccgtttccgatcagtttggttttcttacaaacgtgcgttcaattctgcaccgagttcttcaaatcctggttttccaagaagagcgaacatgtttttcttgtaggcttctacacctggttggtcaaatgggttgattgcattgaggtaaccagagatcgcaattgccaactcgaagaagtagaaggtgtaaccaagtgtgaactcatcttgttgcggaagagtgacaaacatgtttggtacgccaccatctgtgtgggcaagaagtacgccgtccgttgcttttttgtttacaaagtcaacgtcttttccttgcaagtagccaagaccgtcaaggtcttctgccatttcaggaatcaagatattttttcttggtttatcaacacgaactactgtttcaaagatattgcggtttccttcttggataaattgtccaagtgagtgcaagtctgttgagaagttagcggatgttgggttgatacctttttggtccttaccttctgactcgcccgccaattgtttccaccactcgctgaagtattggagtgatggctcgtagttagccaagatttctgttacatagccttttctgtaaaggatgttacggacagctgcatattggtatgcttggttttcagcaatcttatcagatgtaaatgtcgtgcgggctgcgtttgcaccttccataagggcatcaatgtctgcaccagctgccgcgattggcaaaagaccaactgcagtcaagactgagaaacgaccgccgacatcatctggaactacaaaagtttcccaaccatttgcgtccgcttcaaccttaactgcaccttttgccttgtcagttgtcgcatagatacgcttgttggcttcttcttgaccgtatttcttgacaagtaattctttgaagacgcggaaggcaatagcaggttcagttgttgtacctgattttgaaatcacgttaactgagaaatccttatcagcaacataatccaccaagtcagcaagatagcttgatgagatagagtttccagcgtaaaggatttgtggagctttgcgctcttcacgtgtttgcaagtttacaaaggcattgctcaagaaatcaatagctgctttagcaccaaggtaagaaccaccgataccgataactaccaaaacttcactttcattttggattttagctgctgcttccttgatacgagcaaactcttctttgtcgtagttttctggcaaatccaaccagccgataaagtcgctaccaggacctgttccttgacggagcatttggtctgcaagggtaacttgtggttgcatgtattctacttcttgagctccaacgaattggcccaagacttttgaataatcaaatgtaatatgtgtcatgtttttcctccatttatgtaccataatatgataacgctttatcatatttttttcaagaaatttatcaattttcatttattttcatgaaatatgttgtataaatcttaatttttgtgaaaatctaacgaaattttcgcgtttgtaataatcctccaaagtctctcccgactgggttactgtaatccatttcgggagaatcttagatagtaggtaaagcggaatgagggcaggataccaaatgaacatgacttcaaagatgaaccggtcgttgttgcctcttgaaatgtaacgttggcggtattcttctttgagagaagggtggggaatatagatatgaaatggtacaccaccgcgtatagacatggccagcaacattctcatcagaaaattcagcgctactaggactgtctttccttgtctatgaagagtgtagcccttattgacatagattgttttatagcgtttatccttcagtgggcgtttggtggattttcgctcctctttcgttaaatgacgaacactgctattatcgtacttaatgtcagacatttctaagtccacaacatctgtatatttcttagcaagtgtcgtttttcccatacctggaaaggcaaataaaaacataggctttcctccttattcctcagtagaatagcagagcatccaaaaagttttcttaagttgcccctattttgcctctcatttctaaaaataagccaaagaaaaccctctgaaagcctgatttcaaagggttcttagattatacgcaaaaagagcacacactcgacctcgcttagggctgctggattcctcccctgacccgcttcacgcacgaatgttgctccatttaatattataacacaatttggccagagtgcaagtttggaatattaactagctatccgaagttgcttcctcttgcgtcttcatgataagtttagcagccttctgactttctctgcgttgtctgaaaaaatcttgcatgatattggcacattccgcttctaaaatacctgtttctaccttgacacgatggttgagccgctcatctgtcagaatgtcatagaggctacctgcagctccaaactttttgttggttgctccatagatgacctgcggaatgcgtgctaggccaatagctccgctacacatcacacaaggttcaatcgtcacaaaaagggtcgaatcaagcaagcgccaattcccctcaacattgttagcctcttggattgccataacctcagcgtgcatgattgcctgattgagttcctcacgcgcattatgccctctgccaataatctggccatccttgacaatcacacaaccaattggaatttcatccttttctagcgactttctagcttcttgcaatgcttgagtcataaaatactctttttcttcatgtgtatagttcataaatctattatagcacagccctgataacagttcaaaatcacttctttattcgctgctatcaaaatcaatctaacactacttcttccttatcacacatttctttcaaaattctgcccttctattaacttaaaaatataaaaatacctcctcagtcgagaaggtagggggagcaatattgatttttacagatattaatatatcatttattgtcgatattgtcaagaaaatttttaaaaaaattcaaaaacagcctcgaaaggctgtatctgacattttctattacaattcgccaactaatttcacaacattttctactgtgaagccgtagttgtcaataactgtttgggctggagctgaggcaccgaatgtgtcgataccaaggactttaccgtcaagaccgacatacttgtaccaactttgagttgcacccatttcaattgccaaacgacgacggatggcatttggaaggatttcttccttgtaagctgcgtcttgtgcatcgaagagttcagttgatggcacagaaaccacacgaaccttagtgcctgctgcttctaattctttggcagctttgacagccaagttcacttctgaaccagatgcaagaaggattgtatcaaagcctgctgcttcatagacaacataagccccttttgcaaccttgtcaaagtctgttccttcttcaactgtcaagttttgacgagtgagaacaagggctgatggtgtagacttgctagtcaatgacaagtaccaagctgcctgtgtttcacgcgcatctgctggacggaaaacgttgaggtttggcatagcacgaagtcctgccaagtgctcgattggttcgtgagttggtccatcttcaccaactgcgatagagtcatgagtgaagacataagtcacaggaagtccttgaagagctgacaaacgaactgctgcttttacatagtctgagaagacgaagaaggtaccaccatagacacgaagtccgccgtgggctgccataccattcaagatagttcccatggcaaattcacgcacaccgaactgaatattgcggttgagtggatttactgaatcttgcaaaccatcttccttgatgtaggtcatgtttgagtgagccaagtcagctgaaccaccgaggaaggttggcaagaccttagccgctgcgttaagcgcatcttgtgatgagttacgagttgcttgtgagaagccattctcataaactgggaagtcttctggcttgatttcaactacgtcacgaccttccaagatagctgttacttcagctgctaattctggatgagctactttgtagtcttcaactaatttcacccaagcatcgtaggctgctgcaccgcgatcagctacattagctttgaagtccgcatagacttcagctggaatttcaaatggaccatagttccaatcaagcgccttacgagttgcttctgtttcttctgcaccaagtggagcaccgtgaacggcatttgtaccttgtttgtttggcgaaccatgaccgataacagtcttgatttcgataagagatggcttaccagctacttttgccttttcaatagcagcaaagatggcatctacatctgtaccgtctgttacaaggtctgtatgccagccataagcattgtaacgggcacgtacatcttctgtgaaggagtcttttgtttcgccatccaagttgatgtcatttgaatcgtaaagaacgatgagtttttctaatttttgaagacctgcgtaagaagccgcttctgcagaaacaccctccatcaagtcgccatcaccacagattacgtaagtatagtggtcaaagattgggaaaccatcacggttgtacttagctgcaaggaaacgctctgcttgcgcaaaacctgtcgcagttgagataccttgtccaagaggacctgttgttgcatccacacctgctgtgtgaccgaattctgggtgacctggtgtttttgagccccactgacggaagtttttaatctcgtccatagtcacttcttcaaaacctgaaaggtgaagaagtccgtaaagcagcattgacccatgacctgctgataagataaagcggtcacggttcacccagtttggctgagcagggttgatacgaagttctttagtaaaaaggctgtaggccattggagccgcacccatgacgacacctgggtgacctgattttgatttttcgatggcatcaataccaaggaaacgaatcgcattgactgaaagatttgacatgtttttctccttttttaaagtcatgaatttattataccataaagcgttttctatgtctgtttgaatgaagcgagaaataaattgtccgtagaaaagaggcaggactttcgtcccgcccttggagtgaacagtagtaattcgcacatttcatactttatcagagtttatagtgcctctcctcgtctctatggggcaagagagttctaaatcttataataaagccttaaattgaatatttgagtcttctaagaagcaatcatcaaagccacgtgggtggtgatattcgatacggtccttgtccatcgggtaagtatacttgccaccaacttcccagatgaatggatggaaatcgtattgcaagcgttctttccgcattttccagagctgtaggatttcatctgttgacgccatgaagttagaccagatgtcgtagtgaacagggatgattaccttagcacgcaagttttctgccatccggagaaggtcgattgatgtcatcttgtcttggataccgattgggttgtcaccgtagttgttgatagcaacgtcgatgttgaagtcacgaccgtgttttgcaaaatagtttgagaagtgggagtctgcaccatggtagatagttccgccaggtgtttcaaagacatagttgactgccttgcgagccatgagttcatctgtcacaggaagtcctgctaatttaccaccattttcgtcataaccttcgatcggaagtgtcaccaagcaagtacggtcgaaggattctacagcgtggaccttgatgtctttaaactcaaagctatcgcctggtgcgatacggatgatacggtcagctggaaccccccatttttcccagatatcgccactttcaaccggtccgacaaatttcacatggtccaatttaggattgttgatgatggcagcggcagtgctgatatccatgtggtcgctgtggacgtgcgatactagatagtagtccaattcattgatggcaaatggatcgataaccattggctgcacacgcaagtttggttgcaatttgcgcacgccagccatgttagccatctggtgtccccaaaccatatctttcacttttttagtggattttccacgtgatgaccagaggtccatgaccacgttagctccacctggtgttttaatccagacaccacagtttccaagccaccacatagcaaagttgccctctggcactacttcttcttcgatttcttcattgagccaagttccccactctgggaaggttgaaagaatccaggattctcttgtaatatcttgaactttagccattttccattcctcctataaggtacgtttctatgcttctagtatatgctccaaaggcaacaaaaaaaagaccaaataaaacacaggcttgtgttcaaacttggactttaccctaatacagatctgtttcaatatcttgactggataaattggttaataattcattggtaatcagtttttgtagccgttgtttgagttctcgagcggtccttccgtctgcgatatatcccgatagaagcttgtctagttctactgcaaaaacttgtttttcatctgccaaactacgatattttgcaaaatgagtcatgtttagcacatcatcaaaatctaaaatggggtgaacctgcaccaaagggaaatcagtttccaacccatcgctggttgtaatcaagaaatcaacctctagtaagtcttcgacactcttgaattgttcagtggtaaagactgcgccaatcttcttatctggcaagtgatgctggcattgtttataaagtaagcgttggactgacaccccttcatcacagattaaatagacaatctgtgtctgtgccttgcgtgtcccactgcgtcgaatagctcctcctagatgaatcgtcaaataggcaatatctccatcggataactcaatctgccactcctcctccaaaatctttccagaaacccgtgtcatagcaaacagggtgctgtatttatcttggatttgttggaccattggatttttagataggatgccgtaggtttttctgaacaacagagccttacaatgtgccaagagatgtttggctaattcgtcaggattttccaattcaaatggtgaatgtatctcaaaatgatgaataaatcgctctaccactcgcttcaagtcaatgaaatcttggctgaatacatgaacatcgctgtcctttcgataggatagaagtaaaatggcaatcagggagatttctatttcatccaatttcaaatcaaaggtttgcaacaaggcatctttcaattcctgagcaactcggtactcgatacgctctcgaacttgttcaaattctttgagaatggctcgttcttccaagtcatccagctccatattgcgatagctaaggagcaagaaaggcaatactttgagcataaactcgatttcgtagcgattgattttcttgcccagtttcttttctaactgcgatacttgtccctgtaaaaattgtgccatttcttctgagaagagcaactgacaccccaccaactcaaataacttagcttctagaacctgcaaaaaacctttattggcatccaagaagatggtatagagaagtgagtggacatattggattttatttaaagggtgacaaacgagactatagccatgactcttagacacatagagggtcatcttgtattgttcttgagccaactgggttcgaatttcattcaaatcatttaagaccgtattacgagagacttctgtcaactccattagccgttcaatggtcactctttctggtgtgatacagatatataccaacatcagctgaatgcgctcaggcatgctcatgacgtaggtgtacgaatcaatggaatcgagaagatctcgacaggctagtttttgcgcttcggtaagtcgaataccgaggcgaggtaagctttcaatactctctacagttgttggtagggcatcattgattttttctagatggtaatagatttttcgacgtgattgttgcaagcccttggaaatagccatgattgtctcaggttcctgtagaccaatcaggtacctcagtagagcgcaactactcttatctaataacaagattctcctcctctttcccccgtcccgttactatcttaacataattatctgggatattctaataattattaaaattcatctgattattacttgttttacattacataaatatttgtagttagaattaatagatgcttttaataatttctactcgggtaatcagttctccgtgcatgttatctatccgaagggcaacatttttcaaatatacacaggcaccaatagcaatggttttctcttcttcattgagttttcgtgtcacaaaatctctcaaagtctcactaccttcacttggaatttttactcgtgcgatgatattagccacttttactttctggctggcgcgcataataatattattagaatcatcaaactgagtgaagaggtattttctaactgcaaataggatggcgaccgaaataattccaatcaggtaatcactactagaaccatgctctacaatcagttggcgagcaatggcaaccaggagtacctcaatcacggtgctaggtgactgtttgcaaagcattttgataaattcgactccgaccgccaaggtcattgcacgactcagaaaattttgaataaacgtatccgcttgaatatcaccagctaatgagctgagtaggtctgcaaaaagaagcgttgacaaggctaaaagtgctaagccaagtatggcagataaaatcaattctaaatagtaggctgtttctgtcagactatcctgtaaaaatttcctcatctttctcctcatcaaaagggaaaaagcagttctccttttgggggagtctgctacttttccctactgtttttttcacacaagaacttaatgttcatcacccttttgtccatagtaggcatttggaccatgtttacggaggtagtgcttgtccatgatatagcttggtgctggctccacccttggattaatctgctcggtgtagcggttcatccgagctacttcctcaaggacaacgctgtggtagactgcctgagcaggattcttgccccaggtaaatggtccatggttacggacaacaattcctggtacagcaactgggtcgataccacggcgttcaaattcctcgatgatgactgaacctgtttctttttcataggccgagtttacttcctcagctgtcaaagaacgggcacatggtaccggaccatagaaatagtccgcatgagttgtcccataaaatggaatgtcacgacctgcctgagcccaaccaactgcttctgtcgaatgggtatggacaacagcgtggacatttggccaagccttgtagagggcaacgtgggtcgccaagtcagacgaaggattcaagtccccttccactacatttccgtccaagtcggtcaccaccatgttttccggtgacaatttttcatagtccacaccagagggcttgatgacgatgcgaccaagttctcggcagacttctgatacgttgccccaggtaaacttgacgagcccatgagcaggcagggcgatattggcttcatagacccgttgacgcatttcctgtaaatcttttggcattagtttaaccccgctttctcaatcaatggatagaggaaatcttgtgcctccttgatagctgctcgtgtttcctcaaccgtttcgcagttttcagaccacatctcaatcaagaatggaccttggtagttggtctttttcaagactgcaaacatattgtcccagtccacacagccctgaccaaatgggacatcacggaattgacccttggagttttcggttaccgcataggtatccttgaggtgaagggctgcgatagaacggtgtcccaggtaaaattcgctgtaaatgtcattatgccaagcagacacgtttccagtatctggatagacaaagagataaggcgagtcgatttctttttcaacggctaggtatttttcaattgagttgataaatggatcatccataatttcaatgcccaacatgacctgagcctgttctgcccagtcgcaagcctgacggagattcttgatgaaacgctctctagtttcaggtgatttttcctcgtagtaaacgtcgtagccagccaactggatgacacgaacgcccaaatcctgagccagttcgatacactgtttcatggtttctaaggacttggcttcaagagcagggtcattggagccaagcgggtagcgacggtgacctgagaaacaaatggtcggaatgcggacacctgtttcatagatggccttgaccaagtctaaacgctcttccttggtccattccaaacgagccaagcgtgcatcgctctcatctaccgacatttccacaaagtcgaaacctaattctttggcaaactccaaacgttccttccatgtgaagtgtttgggcgttgccttttcatatattccgattggtcgtgccataggtcttacccccagatacgacggatttcgtctttaaattcacgcgccgctgctgctgggtcggctgcttctgtgataccgcgacctgcgataaaggtgaagacatctacaccctcgaagagtttaagggtatcaacgtccaaaccaccagttacagaaacacggaagcccatgtcaaccaattttttcactttattgaggtctttttcgccccaagtttcgccagcaaggagggcgtcacgcgattggtggtaaatcgcttgggaaatacctgcgtccaaccagagttgagcctgttcataagtccagtcaccatagagttcgatttggatttcacccttatcaccacgcacttccttgatagccttcaaagcagctgccatagttggaatagttgctgaacaaatacaagtcatccagtccgcaccacgaacagcattgtttttagccacagtaccacccgcatccgcacacttggtatctgcaacgataattttgtcttggaagaggctacgtagcacttctaccaattcgctaccaacttgaagcaaacaaacggtacctgcctcgataacatccacttcatgaccaacggaaacagctgctttaatcgctccctgcaagtctgaatggtcaagggcaacttgtaaatttggaatatgtttcatgttttttctcctaactttctaaatctaaaccttctaggtaaggactgtttttggactcttccaccattgccaagacttcctcaggagtttgacaagcaatcaaacgctcaatcgaattttccaattcgaagagggcgataatttgtggaatagctacggatgtatgaatctttggatcggtagctgcaagagtgagcagaacagacacttctttcccatctgagaagacgactggttttgtcaaggtaatcaaagcaaaggaatccttcaagacgccgacacctgcttgggcgtgaggcatagccataccaggcatgagcacatagtaaggtccatattcttcagttgatgcgatgatcgcgtcgtagtattcctcagttgcagcaccactttcaatcagcggttcaacagccttgtgaacagcctcctgccaggtttccgctgtcaatcccaagcgaatggaattattttctgtaaatgatttttgtaaattcatagtttttcccttctacacgctatatgaaagggggagggaaactccctacccctaacggctatttatagcactgcttgtaattttgttttgatttcgttgtcgtccatgaggttgtcaagaccaaccaagtgacctttcgtgcgaccttccaactcagaaatcaagtggttagaggctacgacaatatcatatcctgccgctaaaccttttgcttcaccgactgagcaagaagctgattgaaaatctgttacgccgagttgacgaagggcgttttctaccttcatcttgatgaccatagatgagcccatgccgtttccgcaggctgttaaaactttaaccataatttcactcctattttatttttaatacattatgttctgattttacagaccaaggatactattctgcttgtgcctcgccacgatagtacgcttccttatcttttgctttcgcaaattgaagttgcggaatagccaataagaagaggcagacaagaacataaccagcaataccgaggtacttaaatgcaaatccaaatggtaaccatggcacttcaaagtcaatgtttccgtggtaaccaccgctcaattcaagcaagccaacgcagactgcaccaagagcaacttgaaggacacctgagatgaaggaaaggatggctgccgctttccaaccaccacgtttgtcagcgtacactgcgatagctgcgttatcgaagaatacaggtacgaaaccagtgatgatgaggattggactcttgaagacaatcaagagaacgattgtaatcaactgaccgattaaaccgaaggcaaaacctgaaagaactgcgttagatgaaccaaagccgtaagaagctgcaacgtccaccgctgggaatgaaccaggaagcaatttgcttgagataccttggaaggcatttgtcaattctgctacgaacatgcggacaccttgcatcaaaatgaagagatatactgagaaggtgaaggctgtttgaatcacatacataaagaaggcttgtttagctgggttgtatggagcacctgaagtgataacttctggatttgccatgatttctggacccaagatgaacaaaatcacaccgaagaatacaagcatcaatgtcgctgaagcaacaactgtatcgtggaagatgttgaggaagctaggtagcttcaagttatccaagttttcttcttttttaccaagttttggtgcaatcttatcgacaaaccagattgcgaattgttgttggtgaccgatggcaaatccaccgccacctatcaatcgttgggttggctcaactgtcatgtttgagctgactgcccagtagataccacagatgataccaatcgctgctgtaccgaattggttacgaagagccgggatgaggaagagcaccatcaatgagactgttgccgcttgttgtaccatgatgtgtccagtgatgaacagagtacgtactttggtaaccttacgtagtgccaccaagaggatgttgacaccgaaaccaatcaagagcgctgtagtggctgctgatacgaaatcagggaactcctcagcaattttcccatttgctgctgcaagaccgaagtaagggtcaataactgccgcatcaatttggaacttatagttcaaagccgccaaaatcggacggaaggttgtgaccaaaccaccggctgctacgttcaaaatcatatagccgactgtcgctttgataaaccctgcaaaaacatcatgaggctttttctttaagagggcatagcccaccaacactaaaagacctacgaagaaggctggattctgcaggatattctgtgagaaccagtttaatggggtttgaaggaaatccatttttcattctccttttttgaaatgatttttatggttttattataagttatgtaagcggaaacaaaaagaccaaataaagcacaggcttgtgttcactattggactatttccgaactttaatggctgatttaatcagaattcctccctatagttcaccagcccatttattctaataatcaataaatagacgttattttacctaaaaatttaaaagaagaggttggtttgaaaccaacctcttctagagggaagtgatactctcaactcttgtatttataagaaattcacaaggttttgagtaatgctcctctggagagccaaatattattactcttctgattttttagttcttccttgcgcagcaactgtcaaaccaagtccagcaagtccgagacctagaagtgccaaatcgctttgtcggtcacccgtaatcggcagactcgccttgcttgcaccacttgtcgcttgtccagacgcttgagctgttggagtagaaagacttggtttttctaccacatccttagcctccatactacccttaacaacaatccgcgcctcaccatctacaactgtttcagataacagatttgttgctactaccttgccgtcaaccaagacatcttgataaactaagactctcttacctgccttaccttcttgaagcacataagattgaccttttgcaagtgttgcatcatagcgaacttcctctgcaatcggaaggactgtttcttctgtacgttccttggtagtaaagtctagacttggtttttcttcagcagtaggcgctgtatctggaagcgccgtagtgatataaggcaaacgaatcactgttgcagtcaaaggtgcaagaacaactgagctatcagtcaattcgacacccactaaatcagacaatgcttctacacctgcacgttcaccgtcaaccagcacttgacccttaagcaattctttgtaaatatcagaaagaacaaagctgcgctccttactgtcggcgttgacaaaaacagcatagcggtccccattgcttgcaatggtttgataggcaatgaccacatcatttttagcaataccattttgacctggaattgaaatcaagctaaccttctgttcaacttcttcttttgttcccaaacggaaggcatctgtagatttgcgcaaggcaatcaatccttttgtaaaggcctgagtacgggtattctctggatagagcgcctcatctgtcgctttggtccagtcaaacttgttgaccgcatccgatgaatcgtaagaatcatgaatgtagtatggatagtcaaatggtgtaccatcagcatttgtcaacaaatgcgctttgttcggtaccttgtcctctgtaactggttccttataatcaggatggcggaactgtttggtccgtccatactcctgaccagaatgaataaacggtgtcccttgagcagtcaaaactagcaaattacccaagcgttgacgttggtgaatttcagtatagttttcagtaactgacggatccttcttgatggactgagcgataatatcaaagagggtcaagttatcatgcgcagcaatatactggatcacatcacctggatcatctgccaagaagttgcctggttgtgccttgatgttattgaagacagactcaacactcttagcaccgcctgtgataaaggctggctgaccttcgtttggataaccagatttaagtgtattgcgaatttcatctgagaataccgcaaccgtatctgttgaactcatccagtcttggtccgctggctgaacaggctgattagcatcacctgtaaaggttctccatccttcaccaagcataatgatgtttggattgagtttttgagcctcagtaaaggccagctcaattgcttcggcatcatggtcccccatcatatcgaagcggaaaccatctaccttaaactcatccacaagatacttgatggaatcaactaagacacgacggctcatgtagtgagtggtccccagacgaccaccaccaaagcttgatttagccgtaccatctgcctccatgaagtgataatagtttggctctaagtcttcaaataagaaggtcttagaagtgtggttatagaccacatccaaaatcacacccatgccttgtttgtggatttcattgaccagatttttgaactcttcgatacgtttcattggatctgtcggatctgtagaatacatacctgtaaaggcaaagtagctctgtggatcataaccccagttgtagttactgttgcttgacgcgtactcactcatccgctctgcatttttcaattcattgacaaaatagtagctcataacaggcaataattgaatatgagtcacgcccaattccttgaggtagctgagacgctctgcaaaggcagcaaaggtaccaaactgagcagtcaattcatcggaaatagcaggatcggctgtgaagtcacggacatgagcctcatagataatagcatcttcacgctgattgaagttaggaattgtggcatagttcaaatcacttggaccaacttctgctgggtccacaatcgcagcttttgcaatccgataagatggatctgtatctgccaaatcactattccactccgctaaagatttagcatatgggtctaaaacaagaacagattgatccccacgagtgatttcataatggtagtagtaaccacgatagtccgcgataccaagacctgattggctgttcaattcgaggtcccattgtcccttatcccccttggtcatggccaatttaccgaccaccttagattgatcatccttatcataaagaacgactgccacactgtctgcacttggagaccagagagtcatatcaacgacactaccagcctgacgcacacgcgcaccaagctctccatcataagcatagagctcatccttcaactgccagctcatagttgttgtgaagctatcattgccatatttgagggtatagcccgcattttcttggttgaaatccccgaggactcgcaccttgttgctggtaaggtccaagacaaggtccgtcactgcaactgtctgaccattcttatctgttacagacaatttctccaagatgctatccttatccgcaccttccaatgttgtaaaggctgcttctaaggctgttaggctaacgtgagaaacacctgtcgcacggacattattgacaaaataagggttggtgtaaatagtcgcatcatcatccttgaggaagatttgtgtctgatttttcaaatctttaaagctataatctttctgctgaatcttcacatcgtctcctgacttgctttcatccaatagcaagaagccaatggaacttggtaaatctgtcaatttgacatcaatataggcaccgtacttgccttggttttcaaaatcaataccatttggccagtcacccagggtaaggtcagtcacatcaccccagatccagagacctttttgatcataattgccatcggtacggaagtaattgatacggatgtagccttctttaagtggttgatagaggctgagttgataattctcatcaaaccaagcttcattcatcttggtgctaatccgttcaatggtcttgtcacctgtgatgttatcaccagaagtgttattaatcaacagactaatcttgctggctgtttcatctttcatcttgatatcaagataatagccatagtcatcctgtttagccgtgctgaaattggttgcacctgttggccaagcaccaagatctgacgatggtttttcgacatcatcccatgtccataaacctaggctagataaattatcagatggtagagttttaaagtgaacacggaagtagcctgcttcaattggttcttcagttgctccttgcacacttgcattgacgatgtcacctgcttctgtctgaaggagcatggtgccaccttgaccgattgttggcagttcgatttgaacaacccatttaccgtctttctcgatagcttgataagattttcctgtgtaggcatctgtgacaactacatctttaccagatacttcaagcgccatttccttgttctcggtattggtcgagaagacaagataggcagcttgatcttggtaactgcgtttgctgataagccaaccttggctatcatttccagcaagtgtgcttgtatcaccacgtgagagcaatgttgaattggcattgcggaaagccaataatttctgatagtggtctgtgatgtcgctagtctctaccttgctccaatcgaaatcgtaccggttgtcataaactggccagttgttttgtccagattgccccacttcttcaccgtagtaaatgactggctgacctttagcagtaatcaaaagactagcagccaatttcagtttgtccagatttccttctttttctgcgccaccgagactgtagaggaaaccatcttcgtcgtgactgcccaagaattgacccagagaagctgcactagtcagaaccttgctacgttcttccagctcttttccagctgcttttagttgaccattgaccagatatttggcgatatccttgaagccaaagtccaacaaactatccatagtgccgatacccaagtcacccttggtatccttataattcgctccccaagtttccccaatcaagtggaagtcaggatctctatccaccaattcatttttgaaatgttgccatgtggtatcatcaacgtgtttgactgtatcgacacggaaagcatagatagagttgcccttggcagttgttgaacgttccaaccaagatgcctgccaagcaaccaactgattgcgaacagcagcttcttctgtcttgaagtctggtaatccagataatgagcctaattggtcatctccctgcttgtcttcttccttagtccgtaccatacctgcaaaggtttcttctgtaccatagccagcatggttaagcaccacgtcaacaataatattgatgcctttttcggctgcggcatcaatcaattcgtggaaatcagctaaacttcccaaatgcggatttagtttctcaaaattggatgcccaataaccatgataagcatagtattctccatcttttacgctaccaacattctgtggaatattttccacaatcggagtcaaccagatagagtccacacccaattctttcaagtagtccagcttggctgtcactcctttgaagtcaccgccctggtaaagaccgcgtgggttggaggctgttccttccactagcttgtcattgccggtgtctccattatagaaacggtctgtcatcatgaagtagatgacttgctcgtcccagtctttttcaccatctgccttgatacgctctgtaatggtcacatccaattttgtttcgtagtaaccgttgtccttgtcatagacctttacaggaagactatatgtccctggcgctgtgctagacgtcgctttaatggtcacacgattgagctcagtagagattggcacaagacctccaccgatggcacttgtatcgacttccattttgactatttcagcattttcagggttggtgacggttacagataccaagccactttcattgtagttgaatggtgctttcacacttgccccaacagtcacattttttgtacctggagtagctttacttgtatcgagttctactttctcttcgataaaatatggattggtatagactttgtcgtcgtcattgcgaaggaaaatttggctatgccgtttacgatctgcaaaggctaaatcaattgttttattgcctgccaaatctggattattctgattgattagcagaaatccaagcttggaatctaaaccattcgatagaggaatgtcaacataggcgccgtatttgccaagtttaaagtcaacggcacctgctggccagccgctacttgcttcagtcgtatctccccaagtccatacgccccaaccttcataattattgtcttcacgggtgtagttgatacggaggacattttcatctttgagtggctcataactagacacgctataatcactagcaatccaagcctcattttgttccggaacaagtagctccactttctggtccgattctgttattttttccccattcttgagaaccagataaccaatcgttcctggtgtctcagattttttaatatcaacgtaatggccgtagtcatctacctgactgcttgaaaagttcgctgtatccgttggccattgattaccatcggacggctctgccactcctccccaagtccaaagtccttgactttctggtgctgtttcatctacattttcaaagtgcagacgaatgctgccttcttcgataggagcttcctctggagcagttgcatcggctgtttctgttaccgctgtcgcttcagctaccatagaatctgtagcttctatcgcagttgtggtcgcttctaccgcgccgccatcctgttccgaaagagtcgttgaactagttgacgcagggaggacaacttcctctgcctgcactagttgacctgctccacttaaaaacagagcagccgcaatcccaacagaggctacacctacatttagtttacgaatgccaaaaatctgtttcttctctagcatccctgttcgtttcatattctgaacggatttctttttcatagactcctccatataaataagtttgaattgtacactaccagtatatacaattccaaggagtctttgcaaacgttttcttaaatgttaacggtaacaagttttgagctactatctaacaaaaatagaataaatagctcccccttcttttgctcctagaccgcccactgaccaaaaaaagagactactgaggtgtagtctccctttcaattaaggttgcctggcagtaatgcccctgtctagccagaggcttgccatccaatatcgtcattaaatgtttgacgctaagagcccccatttgacgaatcggctgcttcatcgtcgtcaaggctggtctggacatcctatctaaaaagaagccgtcaaaaccaatcaccccaacgtcattcggaatagactttcctagagcttgtaaacctcttgtaaccccaagagcgagacgatccgatgcgcagataaagcaggtgttttctggtaaataatcaagatttttcacaaattcttccgcaacacgagaacgattttccaatcgatagagatgagtttctcggccctgcatcgcatctttgtagccttcttctctccctttttcaaaggcttctggcaagtcaatccctacaaaaacaatcctctcataaccttttgataaagcaaactgggttgcggacctagtcgccaaacgattgtctgaatctacaaaaggaaggccttcttgattctccccaaataaaatcaatggcttccgcagccctttcaaccaagggtagtcatccttgcgagcgccagtcacaatgtaaccatcacattgatcagtgatctgacttggattggtcaccaactgcaaggtataatttcgatgattgagctcatcagcgattcctgcaagaaggtcgatatagtacggctctaccacatccatcttttcgagaatgacagcctgaacaatcagtgtccgttgctgggccaaggccttggccgccacatttggcttatagtttaattcttccatcgcagctgttacgagcgtccgcagctcttgtgtaacttgttctggatggttgatgacacgcgaaacagtcatctttgatacattggctaacctagccacatcggctaatgtcgtcatagaactcctccctaattctatttctgttgcttatcttttagcaagcaaacagtcaaaattgtgcaaacgttttctttaggttattatatactatttattactaaaaagtaaagacctttcgaatacatttatcgttatttagttttccttctattacttccttagctcaccttgcctaacttcatctatgcctgcggctcatcgcctcgtgctaaaagtactatataagaatacccattccctctaaacaaaaaatactccaactgctagaccaatcaatgtctaacaattgaagtatcttggtcaaattctgtccattttctgtacgattatggaaatgaataagataaattaatttgcttagcttactcaacatctaccttttgaatgcgagctaagaattgcttagtacgttcttcttttggctggtcaaaaatgtcttctggtcgaccttcttcgataatccgaccaccatccataaatatgactcgatcagctaccgcacgcgcaaagcccatttcatgagtcacaaccaccatggtcataccttcttttgccaactgcatcatgacagccaggacttcaccgattaactcaggatccaaggccgaggttggttcatcaaaatagatgacctcgggattggtcgcaatggctctggcaatgccgacccgttgctgctgaccaccggacagctgacttggatagaaaccatatttatcagatagtcccaccttgtccaaggctgctttaccgattctttcagcctcttgtttgggtactttccgagccacaatcaggccttccgtcacattttgtaaggcagtcttgttggcaaagagattatagttttgaaaaacgaaggctgtgcgcttgcgaatgcctgcaatttccttcttggtcatctgagccaggtcatagctgtcctcaccgaagactaagtgacccgcgtcagctttttccaaaaagtttaaagaacgaagaagagtcgtttttcccgatccagacgggcctaaaatgacgaccacctcacctggattgacctctacatcaatcccttttaacacctgctgaccaccgaaggtcagctttactccatttgcttgaatcatctgaacctcctaatagactgccaacttcttctcaccataggcttgaagcttggtcaaaatagttgaaaagaatagataaacaagggccacctcacaatagagggcaaacggttcgtaggtccttgctgcaatctgctgagttgccataaacatctccaaaacggtaatattggcagccagcgatgtatccttgaccaatccaatcaaagtattggacaagggcgggaaggccactcgaaaggcctgtgggagaataatccgacgcatggtctgagcaaaactcatcccgacagaatagccagcctccaactgccccttaggcacggactcgatagaagcccgtatggtttccgcagcgtaggcacctgtattgacagaaaaaaccaaaaccgccgacggaaaagcatccaagacaattcctagacttggtagcccaaagaatatcacatagagttgaaccaagagtggtgtccctcgaacaacccaaatatagaaacgagccacttgtttgagaatgggaatctgagcaatttgcaccaaggccgtcccaatagcaattaacaagccaaaggtaaaagacaggattgtcagtgggatagtcaccaacaatcctggaacaagtatttgtgaaaatgaatcaagcaatagttgccatactctctctgtcattgtttctcctgattacttagcttttgatacgtcttcaccaaagtatttgtttgaaatttcagctaattttccttcactagccaattctgccaaggctgcatcaatctctttcacaagatcttcatttccttttgcaactgggaaggctgttgtcgatacgtcatccgtcaaggtcacaaccttaatcggtgcatcagcatgttgtttcacataatccaagtacaccaagttgtcattgatggtagcatccacacgtcctgtatttaacaattcaactgcctgagagaatccatccacaccgacaacttctgcaccattttcacgcgccaaatctgcccagttacttgtcaagctgttggcagattttttaccagataaatctgcaaagcttgtaatgtcagtattatctttttgcgtcaccaaggctccatagatgtatgtatatggtgttgaaaaatcgtattttgccttacgctcatctgtaataccgacttggttagcgatggtatcaaaacgggccgcatccaaacctgcaatcatggaatcccattctgtttcaacaaattccaccttaacacccaatttctcagcaacggcttcggctacttctacatcataaccgaccaatttcccgctctcatcgtggtaagagtaaggagcataggcaccttcagtaccgatttgaataacgccttcttccttaatttgtgccaagagggtttggtctgtactattcgatgtacctgcagatgaattgcaggctgctaacacgatacccgcaaacaataaacttgtaaacatagctattttcttcataattaaaacacactttctttttcagattttacaatagtatcatgaataacaatttccagccaatatattttttctatcggggacattaaaaattttaatcaagtatcggagcataaaaaaagacctactcggtctttatatctcatattaatttactccagctggtgggtaaatatagctgactgttccttcgctagtcgttgttggatcaaagaaacctcggacattacttgggtagtatactccaccatagtttgattccttaacttgaatgtgaccattagctgccacatctgttacataggcaacatgaccgtagcctccatctgtccatacagcaatagcgccaacttttggagtagttcccacttcatatccaagcgctgccgcactagctgcccaatctccaccattaccccaatagtttccaacccaaggagccatttctttggcaccccaagtacactgacccgctggataggtattagccgtatattccaaagcaacctctgacaccatattggtagccaaagcagcctttgcagcggcagcagctttctcagccacaattttttctgcagcagctttggctgctatttttgcagcttcaaccttttttgttaacgctgatactgtcggactatcgcttataactgtgtcatctgcactgacattcaccattcccaaccataaaagatttcctatgagggctgtaaacagtcccaatttgaattgtttttttatcatttgataactcataatatttgattccttcgtgtttttctgccctatctatcctaagggataatccttgcagagagcttaaaggaatgtaacaaatattacagataacttgcaatctcttaacaatcacagtgtccggactttttgtcaaaaaaacgacctccaatacggaagtcgttttctatttagtgttagtgtaattattttctcctactcctgagtacactgattagaataaaaaccaaaccagatataatgtttagatatttattcccataaagcggactaatcgcgataaggaaaaatcctagcgccaataagaaaggagatttgttcttggaaaacattattcctcaccagccttaaccttattggctgcaataacaaatggtgtccaaatcaggaaggcaacaaagaggttgaatagtgaaaccaacgcagccataatgttaccacctgttgctagataagcgtagagtcctggaggggtaatccatggaacaggagcaaagactggcggaattatacctgccgctgtcgctaagtatgcgatagttgcacaaatcggtggaacaattagccatggaatagcaaacagtggattcaataccattggtataccaaaggtaactggttcgttaatattgaatacacccattggagcagataatttagctaccattttgtattcttctcgttttgagaaaatgaaaatagcaataatcaaagctagagtgacgcctgaaccacccatttgagcataagcatcaaaggaaccacgagtccaaagccacggtaaattcgcagtactatgagttgcagtataagcagccgcattttcatttagtgcaaccatatagactccgtccataattggcgccaagacattgtgaccatgcaggccgaagaaccaaaaaagttgtacaaggaaagttaaaagaatgactgacccaagaccttgtgacagactaagtaatggcagttgaatataagttgatactaaatctcccaaagattgtcctgttagagtaaatgcaagatatgccacaatggatgacgcataaattgcagcagtacctgggataatagcagcaaaggccttattaactgccggtggaacagaatctggcaatttaataatgacattccgttttacaagacttgcatagacccatgtagcgagaaatccaataaacaatgctgtaaacaaacctgttgcaccgccatatttcaatgcgatagctccccactggcttgtttccaaggctgaaactccatctgtcgtcacaatggataatcccaaaccttccaaagcagaaacaactgacttatcaactccgtctaaagcagtggaaatcgttacactttgaggaatagtagagatgaatgatgcaaaggaaattaaaccacctgctaaaggattcaccttatacatgagtgacaaattgtaaccaaaggtaaaggcaaatacaagtgccattatcccgatagttccaaaataaacgtaaccattgatatctatcactggttgcatggcatcagcaaaaccagtccatcccatattatttgggatgtctctcagaaagacattcaatagaacggccactgtacctgccatcgtaatgggcatcatagaaataaaggaatcacgaatcgcaatcaaatgccgttgcgaaccaatttttccagatatttccatgaacttctcagaaatatttgacatattctgtctccttttctattttttgttttatatttcctaaatgttaaactgataccggctcaactgagcaacgaatcagcgcctctaactgggcatttgtctgacgttttatactttttgaaaagattttttccatgagaaattgattgccttttacaaaaatatcaccagcctccatctcataagaatattctatattggtttgatcattccctaaatcctctaactgatagcgaacatgctcttttcctcgattagaatggaaacaaactgcatagcaataaggagctgtaaactcttctacagttaccttgacactatgttgtcccttatcaccaaatgttttagtataagtaagtccctggataatgtcttgatcttgcaagatggaacccgtattttgctgaaaatcatcttttaaggattggcgaatagtagcgaaaagtcgctcaattggaacttgacctatttttgatatcttcataacccagttctcctataattatccaatctgtttataaagatctacgaactctttcgctaaatcaataaatgtcaaagcattcatcaagtgatcttgtccatgtaccattaacaaagataattcaacagactctccacttgcttcttttgctaataattgtgtttgcgatttatgggcaatattcaatgaagctattgcgtcttggagcagctgttccgcttcgtcaatacgaccttctttggctgcttgaatcgcctggctagcgaagccctttgcttcaccgccgtacatgattaaccccataatcgcttcaagatactctggagaattcatactacccctccatcatttttagggcagcctctagcaccttagctccgttcatcactccgtaatccatcatattgatagcatctaccttaatagttggctcaaattttgccttatagtcgttcaataggaattttacttgtggacctaagagtaatacatcaatctctttttgagcaacttcattatcggcttcagatactggaacagcccaaatagttgcttcaacccctgtttcttctgctgctttttgcatcttagttacaagcatacttgtagacatgcctgcgttacaaactaacataatgtgtttcataaaaaactcctcctacccctttctttgaatgaggggaataaaaatatcaattaattctttataatttggatgatgtaacaaacgttcttggagaactctatcttgaacaaaatcaaccagacaaggtgagatatacttcagaaatgcatttcgaccctttgacggtgacaataggaagacgaattgaacttgctttccatggccccaatccacagcattcttatatatccctacaacaatttgttctgaataactcatcggcaaggctggatgaggaaaggctaaccgattcccaaagacaaccggactgtaagattctcgtaaattcacttgttctataaagcgattaacaaaatcaggctcaatggattcgtccaaagaggttactagttgcttcaaggctacttctcgatcacaatcctcctcaagatagattattctatgtggagcaaatactgcttctgcaatctgcttagcctgacctacttccattagcacattttccccttggtcaggaataactggggtcgtttgctgtaaatgagatcgaatagcctcaatgtccttctctgataggaagacgctgacattgataaccggtgtcataaaaattagattcgacaagctaatggatgaaataatcaaatcaacatccttcagtcgttcctctgtaacttcataataactaaccgtatcaagaatttctaagctggatgaaaattctttctccaagcgattctttaacatcaatgcacttccaattccggtagcacagactaccaatactctggtcttcttaaatccctgatagcgttcaattgccgccatcacatgtaaggtaaggtaagcccactcatcatccgaaatcgaataccccattagttctggtatcgctgcaaatgccatttttgttaattcgaaagcctcaaaatattggtctttaatttcagcagttagaggatttcccagttgaatattattctccaaacgaatacgtaacggcatcaaatgggccagaactcctttgaatagctgctgatcctttgacaactctaggcctgttaaatgtgacaaatgtaaaagactattctccacattctgtctaaatatctcttccacctcaccatcttgatttggattccccgttagttttaccttaaggtgcaacgcaatgtaatttgcttcctctgacggtatcgtcacttgaaacgtttcttcgattcggtctataatccgttgtgccacaagatactcttgagacgactgaatacgctccggtatcgggaatcggtctagaccagacccgattttcaaccgttgtaaaagaagagcgatatggagcactagattctgcatgacaaaatccgataaacgtaatttagcatcccgacactcgtctaagacgattaacattaagtctgtgaaccgtatatctggcaatagattggtttcgacaaccccataaacagattgaacatttccctcatcaaaaaagtaatccataataaagtgacggatagcaggttcatccccctttagttcaattcctttacgtgtcacaaggagttctaattgataggggataaatagttttcgaatatccgccaaaatggaatgaagcgtagtctttccaatgaatagctctctttgtaaacaatctggtgactgaatcggatcctcaaacaagagcttattgagaatataccgttgccgatcccccgcttcttctagttgagttaaatcagttaaccgcttttttaggagcaattgctcctgccaaaacatttcaaactcaactggccgttcaatctgtaaacaataaccactaccttgttttgaaaggatatgagcaccgctattttctaaagaagatgtcagttgatgaatatacgttcttaccgttcgatcactcactgataataccttggctagttcgatgcttggtacgaatgtctcctgttttgcaagtaaagcctctaacaagcgtacttcttttttagataacatgctccctcctttcctccaacagtctttgatttcttatatgtacattataacatgaaagcgatttctggaggtgcctactttttccgcatcattaatgaaagtgctcggaagctatgaccagtttaaactcttgccacggtttaataaagcgtaacaagggaagatagtctgggctgattcgtccgaccttatttacctttggactgatggtaaattctttgagtgcaatttgcaattcacccttgtagcgaccatataaatcattatcaattaagatatcacctcgtcccacaggaattgcttggtctgaccgagccggtacagatgcgtccttatacaccacacggggcatggttgaacgcagaacataagcagaaatatcacctctataaacatgattaaacgctacaatctctctttcaacgggagtcaaaccctcctcaatatcaaccatgaggctgattgtatcttcatttaaaactgtttgaatggattgtagttcctcctccgagataaattggtttgaaatcaaaatagaatcaataaaacccgttgccttcatccaagcaatttgcaagggaagaggccagaaccgatgatcttctaaagttggtaggccttcagataatggccacggtccttcagaagctgtttgtgcactgacaaatgccgcagttcttatacctgattgatgataaaaagatgacatctctaagaagtgctcttcggataaacctgtaaaagcatgaggataaaaattatggcaggcaataatattatccctgtttgcaacactagccaaaagattggacagcaagatcttatctgtactcaaattcaattcaacttttatgttgcgtggattatgtgtcatctcaatgatttcttccaaaggaagagcttcatcaagacgaatcccggccaaccccagttctgctgcacgctccatcaacgccccatcccaaccttgcgctgcgataaaatggggactgatatctgcaatgacagtcatccccagttgatttgcatagtcaattagtttttgatacaattcgaaaactgttcggtctccattttcaagttgcaacaaactcataaataagcgccttgctccgtattggtgcagaagtttaatgtaagcttgactctcttctagcgaatagttttcaggataaattgaaaagcccagttctaccatcattccctcctagcgatgaaaaccattagcatcgctcaatttcttgaaccacttgcctgatttcttaacaattctttcttgcgtgtctagatccagttcaactaatccatagcgattcttgtatgcatttaaccaagaccagcaatcaataaaggtccataacatgtatcctttacaattcgccccttcttggatagctcgatgtaattcaattaagtgatcttcgataaattcgatccggtaatcatcttgaatgagtccattgtctttaaatgcgcgctctccttcaactcccataccattttctgttacaaaccattcgatattatggtaattttccttaatatttatcgcaatatcgtatatccctttttcataaatctcccaacctctatgcggattcatttttttacctggcatatcatatggggcaaagaaatattccggagttagaggctctccctctttccaactattggttggagcttgtacccgaaggggttgataataattcacccctaggaagtccacacgattttccttaataatggctaattcctcatcgctgacctctggcattagaccatatgcatcaatcagctcgactaagtcatcgggatattctcctaacacagacggatctagaaagctctttgtttgaaacaattctgcaattcgagctgcttttatatcctctgcttgctcactacgagggtaggcaggagttagattcaagacaatagcgatttttttgtgaggatttacctcatggcatgcctttacagctaaagaacttgccaactgtgtatgataagccaccgcaactgccgcttttgcatcaaccttacatggataatgataatttcctagataaccacactctactggaacaatcggctcattaaaggtaatccaacgatcgactaaatcatcaaacaattcaaaacatgtacgtgcatatgcttcataggctcgaacaatttccttattttcccaaccacctttttcttgtaaacaatagggaagatcaaagtgataaagattgacaaagagctgaattccctttgctcttaccaaagaaaaaaccgaacgatagaaggacaccgcctcttgattaatttctccagtacctgttggtatgagacgcgaccattgaatggaagtccgaaatacagtgtgtccagtttcaactagtaaatcaatatctttttcataatgtttgtaaaatgttgatgtttgactagggccaattttgttatgaaatcgttcaggctcaatactataccaataatcccagttgttctgtccttttccatcacctggctcgattccttcactttgaggtcctgatgtagaagaaccccacaaaaaatttgttggaaattgataaaataccttgtctttagtcattgattgttccttctctcttttatgtgctgtatagctggtgcgaattgtggcaaatagttctcatgtgcaagtaacatatcttgtaatagcacttcagcttgtggtccatttgaaataagcgggttgagtgtaaaagcttgtaaagccagggaataatcacctgtcattgctgcctgaacagtgacaagctccatttgcttcatcagttgtaaatagccggttacaatcggcggagttggtggacaagctagtggagttgctccttgcgcagagataatcgaggtgacttctaccacacaattttcaggtagatagggaataactcctctatttacagtagatacggtcaattcttctctactatcattatggatagcacaaataatttgacaggcaacatcactatagtaggcacccccacgtagttccagttgttttggtttgtctttcaattgtgggtctttgtaaagctcaaacaattctgtctctacttcttgaacaaccttggctcgtacattaccctgacgatactgttccaaagcatcctctaacatttcttgttccaaaaaataataacgatggtaatcacatggcaacattccaatcgtccgaagcaattgaataggaaactctagattagtaatatttttgactgcttctggcatctcctctctcaaatccccatacaatgtttctaagattacttgcgtacgattttccccatacttatcccaaacttcatgaaagtgaaaatgatttaacccaatatggcgcgtacttaggtctccttctgattggcctaaaatctgagcagcaagtttcttttgaccaatagggatattacacaaaccaataactttcttccagtggagttcattagcaatggcttccgttacgataccagcaggattcgtaaaattaatcaaccaagcattcggacacaagtccttcatatccttgataatccctttatatgcttcaatggtcctaaatgctttaaagattcctccagccccattggtctcttgccccagcatcccataactcaagggaatggtctcatctaagtatcttgcaggtagttggccaactcggaactgagacgttacaaaatcagcctctatcaatgcttctcttctgtctaaggtcgactctatcttccagtccaggcctgcttttgcgaccattcgccgtgctaactcaactacgatctcctgtttttttgcgccttgttcaacatcaacaaaccaccattctcgaatgggtaattgatgtgcacgaagaatcataccttcaaccaattctggagtgtaacttgagcctccaccaattgtcactaatttaagagttttcaacacgctttccctccctcatcttcttttatattcttattatatttcagtgaacatctattgtaaacggatacacagaccctctttttccgtatcacaacggaaattaagacaacatgatcattctagaaaatacaaaaacgacctccaatacggaagtcgttttcttattatttacatttatttcacaacaatattaactagtttattcggaacactaatcaccttcaccactgtttgaccagctatttcagcttggactttttcatctgcaagggcaactttttcaagttcagctggtgctaagtctttggctacggtcaagcgagcttttaccttgcctttgatttggacaacgatttccacttcgctttctaccagcttgctttcgtcatatgttggccatgcgacatagctgattgactggcctgtatttgcaagaccctgccagagttcttctgccaagtgtggtgcaaatggggcgatcaattggacaaaacctttggcgtagtcaacataaagcttgtcttccttgttggctgcgttgacaaaaatcatgagctgggcgatagctgtgttgaatttcaggtcttcaatatgctctgtcaccgtcttcacagtttcattgtaaactttatcaagcgctccgctattttccgccacaagctccttagtggttaagaggcgatagacacggtcaaggaacttacggctgccttcgagaccttcttctgaccaagcgattgacgcatcaagtggacccatgaacatttcataaacacggagagtgtccgcaccgaattgctcgaccacatcatctgggttaaccacgtttttaagagacttagacatcttagcaggtgcctgctccaactcttcaccagtttccatgtggaagaaggacccatcgcgtttttcaactttatctgtcgctacaagggcaccacggctgtcgcggtagctagttcccaaaatcatcccttggttaaagagtttttggaatggctctttggtcggcacaacgccaaggtcgtaaaggaacttgtgccagaagcgagcgtagagcaggtgaaggactgcgtgctcagcaccaccgatgtagatgtccactggcaaccaagctttgagaagatcctcgtctgccaatttctcatcattgtgcgggtcgatatagcggaggtagtaccagctagaacccgcccattgtggcatagtgttggtttcacggcgacctttaacaccgtcttcacgcaccacttccaaccagtctgtcaagttagcaagaggtgactcccctgtacctgaaggcttgatgtctgaggtttttggcaataccaaaggtaactcattttctggtacggctgtggaagttccatcttcccagtggatgattggaattggctcaccccaataacgctggcggctgaagagccagtcgcggaggcggtaagaaatcttctcctgaccgacaccgttttcttccaaccaagctaccattttggcaatagcttcttccttgttaagaccatctaggaaatcagaattgatgtgggcaccgtcctctgtgtaaggagcttcttctacattgccaccttccagaactggaataatgtccaaaccaaactgtttggcaaattcccagtcacgctcgtcatgagcaggaacggccatgatagcacctgttccgtagcttgccagtacatagtcggcaatccagattggaatttctttaccgttgacagggttgatggcataagcacctgtccagacaccggtcttgtctttagccaggtcagtacgagccaggtctgatttgagagaggcttggcgtttgtattctgccacagcttctgcttgttcagctgatgtgatactatctaccaagtcatgctcaggggcaaggactgcgtaggtcgcaccgaaaagggtgtcaggacgggtagtaaagactgtgaagtccttatctgtgtccttaatcttaaaagtcacattggcacccgtagacttgccaatccagttgcgttgcatatccttgatagactctggccaatcaacttcttctaagtcattaagcaaacgctctgcataggccgttattttcaacatccattggcgcattggcttgcggacaactggataaccaccacgttcagacgttccgtcaggaaggacctcttcgttggcgatagctgttcccaattcttctacccagtttacaggcacttctgcctcataggctaggcctttttcatacaatttggtgaaaatccactgagtccacttgtagtagttagggtcagtcgtattaacctcgcggtcccagtcgtaagaaaagccaagggcgttaatctgacgtttgaagttggcaatattttccgccgtaaagtcagctgggtcattgcctgtatccatagcgtattgctcagctggcagaccaaaggcatcccaacccattgggtgaagaacgttgtaaccttgggcacgcttgtaacggctgagaatgtccgtcgccgtatagccctcagggtgaccaacgtgcaagcccgcaccagacggataagggaacatatctagggcataaaagtttggcttttctgcatctgttcctgtcttaaaagtatgattttttgcccaaaattcttgccatttgggctcgatttccttgtgattatagaagctcatgtcatttctccatgtcaataaattatctttactattatatcacgttttgggggaattgggaaagacaaaaacagccagttttcactagctgttttcccatttttaccaaataatcacacggtcttctttggcacgccacatgccgtcgccttcttgaacgccaaatgtttcatggaattcatcgaagtttggcaactggatgttggtgcgtaggtgacctggtgcatggacatcgacactagccaacatctgcatgaactcaggacgagccttcattcgccagatgcgagcaaagttagtgaagaattcctctgcggagaagtcatcttctgacttggctgcttctagggctgccgcaatcccaccaaggtcggcaatgttttctgacacggtcaatttaccattgattttggcaccgtaagaatcctgaccctcaaactggtcgatgacctgctgagtacgagcttcaaaggcagcatagtcttcctctgtccaccagttattaaggctaccatgctcatcaaaggaagcaccgtttgagtcaaaggcatgagaaatctcgtgggcaataaccgcaccgataccgccgtagttagctgatgaagactgctccagagagtagaaaggcgcctgcaaaatggccgctgggaagacaatcaagttcttctgtggattgtagtaggcgttgaccatgtgagctggcatgccccattccttaatgtccacaggcttgttccacttgctccaaccatgagcaatgtcaatcttgtttagttcgatggcattttccaccaaggacttgcttgggtcaacaagcttcttataataacgctctggcaaggcttctgggtaaccgatataaggcttgataacattgagtttgacaatggccttgtcacgcgtttcctgagccaaccagtctgccgtttccaaacgagatttgtaaacctcaatcatcttggcaactttggcttccacatcggccttggcttctggtgagaatttttctcctgcataccaaagaccgagggcttggttaaagtagccttgtgccaagttgtaggctgctttttcttggttttgcgcctgcggtgtaccagaaagagcacggctgtaggctcctgctagaatacggatttcatccgacaggaaggctgtataagctcctgccgctttcaagatcaaggtcgccttcaaaagctcccaattatccgcacagtaaatgtcctttgcagcctgccagaaacgttcctcaggcacgataatcttgtctggcgtttgacctaaaatcgctgtgaagaaatcatccaaaggcaactctggtgccaaggcagtaaaatctgcccactcgtaggggtgatagagttttgcatactcagaaccctcttcatttgacagaacatacttggcaatcgtggcatctagttccaaacgcttgtccaagaggtccttgatttcctcatcactgaaaccaaacttaggtaagagggcttcttggctctctctccacgttttgagcaactctgctcctttttcatgcccttcttcatagtaggtcgtatctggcaggataatgcctagagaatctgcccagaggacattggtggtcgcgtccataaagtcaggtgccacaccgaaaggcatgaggtttggcttgcctgccaactcatattctgccagcttgctggtaaattcttcgaaagagttgagagccttgtactctgcaatcaaggcctgggcaggttctgcacccaaacggtcacggatttcatagtcagctacttgtttgtgaaaagccacaaagttttgcaaaacgctatcttctgggacatcttctcccgccaaccaagcgtttgtcgtgtcaatcatgagcttttcaatctcatccgccaagtccgtgaaaccacctgttcttggcttatcatctggaatcacggctgtttttgcccattcaccattgacgtattcgtaaaaatcatcttgtaaacgtatcattgattttctcctttgtctttcttaatgactataataacaaaaaattctgacaatttcacttatcagatgaccgtgaccaagtattttttagaataatactcgaacaaaccacaagaaggctgacaacggcacaggtccctgacatggttaaatccagttgattggccactaaaaaacctagcacaaccgttagaatagcgataccttgccctaaaagaagcaattgccaaaaggatttgacccaacatagggcagccatacttggtgccaccaagaaaacaataacagtcatcgaaccaatcgcttcaaaggccagaacagtagttaaggaaactagaatcaaaataaccatttctaaaatccttgttcgtaagccagacaaacgagcatggttgctgtcaaataggtacacttgtaaacgatggtaagcccacgcaaaaaatagaacaataaccaaccaagccaaactcgacttgaccagactaacagggagtgaccaggctagaacatccatacgatggagcggagcaaaaagtacttccccctgcaaaaccagatccacatccaagtgaacattgcgagcaaaaagagaaataagtaaaaccgccaccgcaaaaaagaaagaaaaaactagacctgttgcggcatcatgcgctatctttcgactatgcagacggtcaatggcaagaaccgataataacccaaacagactggcaccaactattagcaatggcgaatccaaactatgactaataaaaaatcccagaacaatcccaagcaaaacagaatgcgatagcgcatctgccagcattgattgattttttacaaccagtatcgagccgagcaagccacaagaactagcaataaccatcaaaatgagtaatacttcaaacacgaccattctcctttctgacataggtaatatacacaaatgcagacagggtcagacctgtcagacagacgataatagtcggtccggtcgacaaaccagatacactggagctaatccaggtccctacgaaagccgacccaattgcaacgattcctgccagtaatagactcttgtgatacgattttcccagcatcaagccaaagacagctggtgcaatcaaaaaactactcatcaaaatagctccgactaactttaatcctactgcaattaggcaaatcatcaaaaacatcgtcaactgctgcaagtactttacacgaacaccaataacccttgcaaaagtttgatcaaacagatatagcttatagtcttgataaaagaaagcaaacaatgccaaagccaatagagaaataattccgatgagtatcacatcatccagctgaataaaggctgcctgtccaaatagataggtttgcaatccagcctgggaagcccctgcaaaggcttcatttccctgaatagcatttttcaagaccattcccaaaccaaagaaagaagcagacaccaatgaaagggcattgactaggctgtgacctccttttcgacgcagccaatggacaagtgcataagaaaggtaacctgacaacactgctcctaacagcaagtagagaggatgtcgcgactgaaaaatcatgaaagagacaatcactccaggataagaagcatgcccaagagcatccccaagcaaactctgtttagtaagaacagatatacttccgatagtgctggctgctacagctaggctgacggtccctaaagcaactgtccagaaagaatactctttgaaaacctcaaacatgactgcctcctttggcatttcctagaaacaacccatttcctatgccgtaggtcgcctgataattctcgcttgtcaaagtctcatccatcggaccagagtcaatcacatgcttatgaagccagacaaggtgatcaaagtaggcatccagcgtcgttaagtcatgatgaatgacaatggaagttttcccttcacattggaactccttgagcatatccatgatcatgatttctgttgcctgatcaatccctgctagaggctcatccataagatacaattctgcttcctgtgccagggctctcgctaaaaatacccgctgacgctgcccacctgaaagctgatcaatctgacgatggcgtaaatccgcaatttttaaccgttctagagcctgctcaacaatctgtctatcagccttagtcggtcttctaaacattcccttactatgagcgaagcgtcccatcagaacaatttcaaagactgttgcaggaaattgccaatttacttgactggattggggaatataggctactttttgagcaatcaacctctctagacctgcctcctgaccaagcaagcgaacctgccctgtgtcaggtttttccaaccccaaaatgaccttgaatagactggacttcccagcaccatttggtccaacaatagccgtccgactccctctgggaatcaccaaattgacatcttctaaagccatggtctggctggctgtatatgctaaattgacatcttttaattcaatgattgctgacatatttcctcctatttttaaaaatgatatgcctcattcatactcaatgaaaatcaaaaccagaccaacctaccaagctgagaaagtcgataagattaagataccgtaccaacaaattgctggcaaaccctatacatcgcttatttcaacacatcagtacatgaatttgattttcgcagagcaccaatgcttccttcaatcgtatgtttataaatctgttaaaaatggtccaaaaacggaaagaactcgacctagaccgagtcctttttactactcatttgaaatctctattcacgcacagactactgatatataaagtcccgctgtaaaccaagatcatcgaggtctacaagcggtatttctagtcaaggacctcaataactggtgtgatttgctactaacgcctatcctcccccaagcgttaccacctccaatagaaagagccctataccgcttgtgctcgaaacaattgattgtccctcatattggtacctatcaactctatctttggtaatatctctagtcttcattgaatagcaagtccgttcgacctgtactatttcagatatttaaccatcagtttaacattatgtttgtacatgtcgataaaggtatccccttcctcgccttctggtgccaaggaatctgagaacaactctttaccttcgccagtaacaacttcaacctgaccacctttggcttttactgcctcttgcaatttcttcatgcgttctggattggttgtagactctgtaaagatagccttgatattatggtcgatgattaggttaactgtctcaatcatgtcactgttagccacttctgagtcggtgctcacgccttgaggagcataaagagtgaagtcataactagcagcaaagtaattaaaggcatcatgtggtgttaccaaatagcgactttcttttggaatcacacttaattctttttctacccaggcatgcaaatcatctagctgcgcttggtatttttctgtatttttctgaatcatctcagctttagcaggtaagagtttttgtagttcctctgaagctacagctacagctgacttgtacaagggaattgaaaaccagaagtgcggatcgacaatctcttctccatcctcatccatcgtattcaagtcttttgcattaaagtttttagaaacagctactccggtcttctccaaagcttcaaccattttaccttcaaagtgcaaaccgtgatagagaacaaggtcagccttttgtaattttgataaatcactagatttggctacatacaaatgagggtcttctcctgctggaatcagcaaatcacgttccacctcatcacccgccaactgatagaccatgtcattgaggaaggaagtagtcacagccactcttggcttactagagccttctgtggtttgcgatggacgacaagctcctaaccctattagggacaatagcagagcaaaactgaacaatattttcttcatataggttctccttttatttttattaagcatacctaactatataattagattaatctaaaaaaatcattttgtcaactgatttttaaattttttgatataatagtttcagaagaaagcgagttctcatgacaccaaacaaagaagattacctaaaatgtatttatgaactgggtcaattagaccaaaaaattaccaataaactcatcgcagagaagatggccttctccgcaccagccgtttccgaaatgctcaaaaaaatggtagccgaagagctcatttctaaggatgccaaggcaggttatctcctcagtcaaactgcccttgaaatggtagccagcctctatcgcaaacaccgcttgattgaggtattcttagttgagcaacttggctactctccagaagaagtacatgaagaggctgagattttagaacacaccgtttcagatcactttatcaatcgcctagacctgctactggaacagcctcaaacttgtcctcacgggggaagcattcctcaagcaggacaaccgctcatcgaacgctaccagacacggctgtcacagctaactgagacagggaactaccagcttgtccgtatccatgacttctatcaactccttcagtacttggaacaacatgaattagctgtcggtgatttactaaccgtcacagccttcgaccagtttgcccagaccatcaccatccagtacaaggacaaagagctcgccgtcccaacagccatcgctcaacaattattcatcgaaaaaagcaatcgcccagcctaaacaagctgagcgattttttcttctaaaataaatagttacctctttttcaaattacggaaaatagatctggctgcaaaaaatagttgcccacatacatacaccaaccaaagtaggaaacctatataaaaacagcccaatagaaaatgagggttataggttaaaggctgcaagacaaacatgagaatccctaccaacccccaccgcataccccaggtcatctttctctggataatccactccagccaatcttctccaactgaacttctggtttccagatactcttgattaaggtcttgaaaaaattttctcatatttctgcccacctctgcacttgatagttagcaattataaaattgccaacttcctctcagtatacaggcatttccacaaaatgtctactgtcaatttttatccaccaatctgcaccaaaccaaataaaatttggaggaataaaatggaggcattatagaagctatgtgcaaggatagtatccgtcattcgtctattgcacatatacagatagcccagataagcccctgtgataaagtgacctaaaaatgccactgaaaagttccaggtatgacaataagcaaatagaagggcagaaaatacgatgaccatttgaggatgcttaggaaaatactgggctgtcttttctaacaaaattcctctgtaaagaaattcttctaaaactggagcaaacaagacaactgagagagccatcaccccaaaattgtccgaatttaactgattgactgtatccatggcgttagaatcactaaggctaagacccaaatactgccaaaagaggttcaggcaagtttgtccagtaaataccagtgctgtcattccgactatttttaaaacattcagcttctctcttgaaaagacttgatgcttcatcattcctcgtctgatgacagaaagtagtgccaatattggaagaccaagccctatcatgactgcaagttttagtagcacattctcttgaaaggctgttatccccacataagctggaaattgaatgagcaaagtgagcagcaaggtacccactgctaaaacgatggattttattattttcatattctctctcctttccattgtcatttataacctactcaattgtttttcacaatgttcacacctttaaacacttataacatttaaaatggtcacaatactgttcgacaagatatgtgccactatcggatatttgagatggttcgttttatagtaaatccaagaaaacaaaaatcctggaaaaagtgccgaccagaaactcaaagaaatttcataactatgtacaaaagcaaataaaactgctgtaattaacacgctaatatttaatggattcactacacaagaacgatgtgcctggtaaagtctttcatcagctttcgctatatccgatactttcccgtaaaactctgtctgacctgttttcgtttttaaaatgactttatgaatcgttgatgattttcaaaataaaggatgtcactaaaaggaacttgaatatgagcagtttcagttttgtatacaaaagaattttcagctacagtatgatcaatattttcaaaagcatgcactaagacatctgatactgccttttgaaagtcactatcctccaggcctttatctataaaatctaaagcagaaacctgataacgatatgttactggcataaattctgagtgagttgttacaaagacaataacagcataaggatctcgagcccggatttctttagcgatttccattcctttcttttcttctccttttatttcaatatctaaaaagaaaaattgatgattccctgcttcctcaattgattccaataattgatttggtttaccaaaaacttctaggaatttataccttactgacgtttcttcaacacactgcctaatagcattttctaacctgctctgctgaaaaaaatcatcttctaatacaaaaatattaagcattgctatctcctaaactttttgtaagttataatcattattatagcatatttagacaaaagataagtgtccaacttgacttggtagacctgccaatgtataataaacataggaaaaggtagttgctggaaacaactaccccttgcagaaccgtttaagacggtggcttgttataaattattaaaaaataaccgtgaactcgccaaagttatagacggttattttttttgtcgttttcaccaattcaagtactaacatcacgagagcgataacaaagttaccagctacaaacatgagtgttaagacctcaaaggttgacaaagatagcttctcctttctgttagattttgatgatttgcccatagacaccacctacctttcagaaattagagccaccgtctttacttttctgcaaaaactattatagcacagttaataaagaattgtagtccaatttacacatcaaaaaaccagcctacttgggctggtcttcttggagtcgctctcttaggcgacgacggtataaaatctgcgatggaatgaagtaaagaaaacttgccaaaataatccaacgtttatctattccactaaagtaaatcaccaaaatcaaaagaaaggcaatcgtcaaataaaagaaatgatttgtgagcaattttttcatagcatcctccatacctatttttcaatattagtatatcaaaatacacaaatagagtacataccattgccaaaagttttacttatttttcgtatccaaaacaatggtcaccggcccatcattgaccaggctaaccgccatatccgccccaaaaacgcccacttcaacaggcacaaaggctgacaaggcctggttaaaagcatcatagagttggctggctagggcaggagctgccgctcctgtaaaggcagggcgattgcctttttttgtatccgcaaaaagcgtaaattgggaaatggataaaatcttgcccgccacatcttgaacagacttgttcatcttgcctgcctcatctgaaaaaatccgcatattgacaattttacgaacagcatagtccaggtcttcctggctgtcatctggccccacaccgactaggagcaaaagcccttgttcaatttgcccatggatacttccttcgatggtcacactagcctgtgatacacgttgtaatacaattttcatcttatccgttggtccttttcactgagtaaacttctggcaccgacttgatcttgtccaccagactggtcaaggttgccaggttagaaatgccaaaggaaacgtggatggtcgcaaacttcatatccttggttggctgggcattgactgacgaaatattcttgctggcattggtcaaaaccttgaggacatcgttgagaagacctgagcggttgagaccgtaaatgtcaatgtttgccatgtattccttggtcgaattctcatcctcccagtccacatcaatcaagcgaacatcgtagttttcttgactcttgaggttcatacagtccacacggtggaccgctaccccacgccccttggtgatgtagccgacaatttcatcgccaggtactgggttacaacatttggcaatccgtatcagcaagcctgacgctccttcaatgaccacgccaccttcgtgacggattttcagactatctttgttgtcgtgtttgacttcgccaccgttgaccaattcatccgcgacagctttggccttagcccgctcagcttcgcgacgttctttctctgtcagacggttaaagattgatatggcagaaacttctctaaaaccaactgccgcaaaaagggattcgtcggtcttatagctggtcttttgcaggacctcatccatgtggcgacggtccaggtattggttgggaacgtagccattttcttggagtaggttctgaagcatctcacgcccttttgaaacagacaattccttgtcctgattcttgaagaactgcttgattttattgcgagccttgtgagttttaaccaagttgacccagtcacgacttggaccgaaagagttggcagaggtgatgatttccacctgatcgcctgtcttgagcttggtcgtcagaggcaccatacggccgttgaccttggcacctgtcgcccgctcgccgaccttggtatgaatctcataggcgaagtcaatcggtacggagtccttaggcaactcacgcactgcaccatctggcgtgaaaacgtaaatacgctctgtaaaaatatcgtccttgacagaatttacaaaggtttgcgcatccccagccccttcttggagttcaatcaggttgttaatccagcgcaactctttttcactagcagttgccttgccaccacgcttgtaggcccagtgagccgcaaccccgtactctgcaacctggtgcatttccatggtccgaatttggaactcgattggacctctcggtccgtaaaccgtggtatgaatagactggtagccgttagctttttggttggcaatgtagtccttgaagcgacctggcataggtttccacaattcatgaatataccctaacatagcatagacatcgctcggagtatccatgatacaacgaatggcaatcaagtcatatagttgatcaaaccgctttttcttatcgtgcattttgcgatagatagagtaaatatgcttgggtctaccgtaaatctgaccatgtagatggcgctcttctgtataatctcttagcttctcaacaacttcattgaccaactcttcccgttcacgacgcttctcactcatcattcgagtaatcttgtagaattcaatttcattgagatagcggaaagacatgtcttccaattcccacttgatagaagaaatacctagacggtgggcaagcggtgcatagatttccattgtttcacgtgaaatacgttcctgcttgtccttgcgcaagtgcttaagagtccgcatgttgtgaaggcggtctgccagtttaaccagaatgacccgcatgtcttgggacatggctatcagcatatttcggtggttttcagccaactgctcctcatgagacttatactcaaccttacccagtttggtcacaccgccgacaatatggcgaacctctggaccaaattcagcctccatatcatccaaagttacatccgtatcttcaaccacatcatgtaagaaaccacaggcaaccgtcacagcatccagcttgagtcctgctaaaatacctgctacctggatcgggtgtacaatatagggctcgcccgatttacgaaattgtgacttgtgtgcctctgtcgcaaaatccaaagctttcttgacaaatataacatcttcttccggtaaataggtggctgtcaaagcaaccacttcctccccagtgtagttaatttctttcatatctctactcttcctcttatatttcctactattctaccattttcacgaaaaaagaaaaaggaatctaacataagactactaattacaaacaatccaaaccaagttcagattcggtgaacgttcttgttttctttcgttttcttgttattttcactcgtttttcaaacgaacgttcagaattagtcttgaattttgcatttcttagctgtataatgattgtagaagattattacaaaaagaaaatggaggattcttatgaattttcgtttcagtaagtgtgccgtagcactcacactagctctcttagctgcaagcaatccaaaattagctcaagccgaagagattctcaacacaactccagcttcttcaacagaagcaagtcaggctgtaccagttgaatctgacaccacagaggaagctgataatacagaatctccggttccagccactaccgaagctgaaaatccaagctcttccgagacagctgaaactagtgatcctacaagcgagacaactgacacaactacttcagaagcacgcacggtcactcctgctgcaactgaaactagtcagcctgttgaaggacaaactgttgatgttcgcattcttgcaacaactgacctccatacgaacttggtcaactatgactattaccaagataaacctgtagagacactgggtctagcaaaaacagctgttcttatcgaagaagcaaaaaaagaaaatccaaatgtcgtattggtagataatggagacaccattcaaggtactcctcttggaaattacaagtctatcgttgatcctattgaagaaggtgaacaacatcctatgtacgccgccttagagactctgggatttgacgtcggcacacttggcaaccacgaatttaactacggccttgcctacctcgaaaaagtaattcgtacagccaacatgcctctagtcaacgccaatgtcctcgatccgactacgaaagactttctctacaccccttataccattgtgaaaaagacattcacagacaccgagggtaaaaaggttacactaaatgtcggtgttacagggattgttccccctcaaattctcaactgggacaaagcttatctagaaggaaaagtgattgttcgtgatgcagttgaagccgttcgcgatattatcccaaccatgcgagaaaatggcgcagacatcgttctggtcctttcccactcaggtatcggcgatgaccaatatgaagtcggcgaagaaaatgtcggttaccaaatcgccagcctgtcaggagttgatgcggttatcacaggtcactcccacgcagaattcccaggaactgccgaaaaaccaagcttctatgctaaatactctggcgtagatgatacaaatggtaaaatcaacggtactcctgtcaccatggcgggtaaatacggtgatcacctcggcgtcatcgacctcaatctggtctttaaagatggcaaatggacaactacttctagcaaagcggctattcgtaaaatcgatacaaaatcatctgtagcagatggtcgcatcatcgaccttgctaaagaagcccataacgaaaccatcaaatatgttcgtcaacaagtcggtgaaacaactgctccaatcaacagcttctttgcccttgttcaagatgatccatctgtacagattgttaacaatgcacagatttggtatgcaaaacaacagttggcgggtacttcagaagctaatctaccaatcctatctgcggctgcaccatttaaggctggtactcgaggcgatgcttcagcctatacagacattcctgctggcccaatcgccatcaagaacgtagcagacctttacctctacgacaacgttgtagccatcttaaaagtcaacggtgcccaactcaaagaatggttggaaatgtccgcagggcaattcaaccaagttgacctaagctcaacagagccacaaaacctagtcaacacagatttccgcacttacaattttgacgttattgacggagtaacttatcagtacgatattacgcaaccaaataaatacgatcgtgatggtaagatagtcaacgaaactgccagcagagttcggaatctgcaatacaatgggcaagatgtgacagctgatcaagaattcatcgtggtgaccaacaactaccgtgcaaacggtactttccctggggtccgcgaagcttctatcaaccgattgttgaacctggaaaaccgccaagccatcatcaattatattatcgctgagaaagttatcaatcctacagcagacaataactggacctttacagatagtatcaagggactcgacctccgcttcttgacagcagaccgtgcgaaatctctagttactgaccaagaatgtattgtctacctacaggcttcaactgccagcgaaggatttggcgaattcaaatttgtctacactgaatctaaagtagtgactccagatgaacagcagtcagatcaaggtaacacaggtcaagatattgtactcgaatctggtcaacgaattactcttccagcggtaaatccacctgctcctgctccacaacataaattggctagtccacattcacaagcgagcaccaagacactccctgcaacaggagaagctacttctatgcttagtctgctcggtctcactttgattggttttgtcggcgcatggactaagaaaaaagaacattaaaatagacgagactgagcaaaaactagcccttgttcaagcctcattgcttttgactcgtcacgaacctcttaatactcaatgaaaatcaaaagtagcctaggaaacgaagtcgaagatagaactggagttcatcaaggcaagttgacaacggataattttgtttttcgaagagtataaagaggcgttcgtacgacttgtcactataccaatacccttttgcactcaataaaaaaacacagatagactcaagctgattttgatgaaatccagctaagctgtctgtgtttttcttttgctcccattgttttggactaatttcttaaccaattttcgttaatactcaatgaaaataaaaatcagactaggcgacgcagatgcagatagaaccgaagttcatcaaatcaagttaacaatgtctgcttttgattttcgaaaagtataaattcatgctcactaggaggaagcctatctttgtttcaaccctcttttgacctctgcatacgccaaaaacacccttcatcctaccaaatataggttctaataaaacggtaaaggatataaagcaacaagacccaaccaaatatcgtcaggtaaaatacaagactgaatgaatattgctgaaactgctttatttcacgttgactggtctgactcacttcatcagcttcctctattacatctgattcgcgataagcgttgactaacaagcgataatcaaaaggaggaactagtggatcacatgtcaacaaggttaccatatcctgactctcaacaggtaataacttttgccaatctgttgcttttatcacttctgtattttttaccaaatacgtcagcgtcctcccaccaacctcaataaaaatcttatcgccttctctcaactctgacagtcggaaaaatctgagatcattgtaccaactacggtgaccggcaatgacacttcgtcgacctattccacctataggtaaagctgttcctataacagaagcaactccatcatttaaatgttcactggttgccccaacataaataggttgtcgaatttcaatttttggaatactcaaataaccaattgccccttccattaattcagaagataacacatcggtactatttgaatcatttttttctgcaaagggatcaactgtgggtaagtcaccaccactaacctgttccccataagccttaatttcttcgagttgctctgtcgaaaagaatttagaattcctacgataatactgatactgttggaaaacttgaaactcctgcactgacatatttgtcagcaacactaaaggaagcaacaaaccaaccaatatgaaaacatatcctattcttttcatcatttcatttcccccttttgatacttcttcctacggagaagatagaggataataacaatcactactatgattaatagggctaccaagtaggatagcgttagcatatccaaaaagaatgccggtttttgcttgattgcaactttcggttcataaggaacgcgatgtccacgtaccaacaaacgatggctgttaatcatataaggagtacaggttagcaaggttgcatagtcttttccgttttgaactataacaggatcaaaattattcggttcaacaactaaaatctggtccacctcataagccaatacctcagctatattatgaatgtagaattgatccccgacttttaaatgatcgagattggtaaatagcgaagcattaggaagaccacgatgcgccgtaatcacagtatgagtactttctccaccaactggcaaggaggaaccttccaaatgccccgctcctttttgtaatacttcctcagttgtcccagcgtatataggaattctctcgttgattttcggaatttctacaaaaccaattttctccttcacctcaagcatacgagcgtattccactaccccagccttctcttcttctgtgtaaggatcttgcaatttgtgaggttccaaggtctggttgtaggccctagcatgctccaaccttttcagaacttcttcactcggtaactgttgtgcttgttcataaaatgattggattttataatcagagtcataacgataataatattgagaaatccacggatatagcgtcactactaaaccaaagagaaataaaagcttcaagagtatggactgtttagatattccctttctaagttgtgaacgtttcatcattactcgtcactttctttttatttttccgcctttttgttaataagaaaatcagtaaaataccgacaaacattccgagcgcataaagaagataacgaataagaatacgcttctctgcattttcagacgctttaagatgctcttctgcaacataaggaatacgatgaccgcgtaccaataaacggtgcgtattcaccatgtaaggcgtacaggttagcaaggttgcatagtcctgcccaggcttgaccagcaattcctcaaattgagttggttcagcaaccactatttgatctacttcatacgctaatgtttctacgatattgtgaatgtagaaagtatcaccgatttttaccttcgttaagtctgtgaataaccgagctttgggtaaacctgtatgagccgttaagacagtatgggtatcgctccccccaatcggtaaggatgttccttccaaatgccctacacctttttgaagaacggtctcagaagttcctgcataaacaggaagcttgacctcaatttttggaatttcaacataacctatcttttcatgcaattccagcatccgtgcatactctacccgtccagcttcatgtcgtgatttggtatacggatcctccgaaaccacattgttcaaactctcattaaaagcttgagccaaatctattcgttccttaacctcctcagaagctaaggtcttcttttcttggtcgaaagaattagtcagctgatccgactcatatcgataataaaaattagaaacatgaggataaagtaaaatcccaaatccaatcaaaaataccaagtaaaaggggatattacttttctttttttctttgtagtttttcccgattttttctgtatcataatccgaacttcattattcttccattgtctttctactgcattgcaaagttaatactcaatgaaaaaccaaaagtagcctgagaaacgaagccgaagacagaactggagttcatcaaggctagttgacaacggataattttgattttcgaagagtataaaatcccctacattctgcttttattataccataatccaactttaaaacgaaaaatcccattgccccagattcaacctgacaatgggattttccctctattctagtctgtcaaacgttatcgcttagtataagttaccaagcgataacctagcaagaagagcaaaataccggtagataaaactgcaatcaccaccacatttcctgtatatggaatttcaattccaggaggtgtaacaggtttattcttaatcttaataatctcggacacatgtgaatccgaggttatttcaaaaggaatcgtatcttgagataaaatgtagccagtaggggccttgacctcttttaagtagtaagtaccataaggaagaggacctaccacaaactgaccattcgaacttgacgtgacgtgataagaattgccgtcgactatcacttccttcaattctccgcctacttcctcaagaaccgcaaattctgccccagataaaggggcggtgctggttgatacctttaaaaatggcttgctacccttttcttcgctaggtctcctgaccttagcctcaatctttgtaacacctctacctacattcatcaagaatgggataacttctagactcgtaggctttcctacttgccgaacataataccatcccttagtcaatcctcgaaaagtggcttgaccttctggagaaagagcttgagaagaaattggctcaccatagagactggtcaactcagaccgacttttttgatataaagaatctgccaactgttcagaagaaacgggttcttctgaagcgatgtaccaagcctccaaacccgtcgaaacttgactggcatctattccattagggaaaggaatatgaacctgaacatcaaaagaatcttgtgcttggagtgaaagcgagggcaatgataatacacatattatagcgacaaggcaacatattatttgtcttactgttttcatctgcccctcctttctagtaataattaagcttcttcagattgacgctttttcatcgcgataaaggcaaataccatagtactcaaacctacaattgtgaaaacaagtgtaccgataccacccgtttgtggaatggttacttttttgtttttgatttgttggaagttatctgctgtcaatgcatctattgtaccccatgtatgtgctcctacagtgaattccacaggcgaagtagggagagcgaatccttctggagccttggtttcaataagttcatacttaccttctttaagacctttgacttcaaacttaccatctgttgatgatacaaatgtaaacgcaccttccttagtacctacccaagtccattgcatgttcatcttttcgtaagcagtgtcgcgagcatctttcttctgcttaatttcatcaattttaggattgtctgttgtggctgatttaacagtagctaaataatcagcttccgctgctttataatctgcgatttcttttgcttgtgttactgtatctttcaaagcaagatatgactcttcaccatctttacgaacgatgaactcagcacctagaagtttttcgctactgtccaaatccttatcatctgtcttcacaaatcgtttaccgtatgtgacaacttttggatcttctggtgtgagcggagttggatttggatttttcttgttttctattctgatagtacctgtatcaccatttgaatagctaggaagtgagcctgaaacgattgtttcttcaattacgatgtattctttagcaccatcaagaccagttaattttccagtattaacacctgctgcaagtttaatttcacctacacgtacaccagttcctttttcatatacaccgaatacaacttctgtttggtttacaccagtatcccatgttttgttaacaataatttcaccatcttttggagttgttgattttggctcagagaattcacttggacggttaccgtaaatcaattttacttggttagggatttcagtctctactttcgctgagtcatttaaagtagccttgtaagtcaaggtaaagttcacttcaccttctcttgctttttcttctaatttcgcaagaccgttattattcaatttcaccatgaatccacgtacagtttgtgtcaatgtgtagtctgtatctgctacaaaggttaagatttttattatctgcgatttgtagtgagtttagtttgaaatcaagacctgcaagcatggtatcttcccaagcaaatgtcttatatgctgcgtccttagggacttttgttgtaatagtgtaaccaatttcctgaccgatttcaacattttttataccatcttgatcaacatttgttctcttatcagtgaattctttggtgatttcaggtttgttttcagtattctttggatacacatgaagaggagttttggtatcaaagtatccagaaccatctgttttagcctgtggcaattcaagcttgaatggtacagctttcataccagtaagttcattctgattattgtagtaaggtgaattttctttatcttcagtgaagatataaatgccattagctagagtgaatgttgcaccgttatcttgtgtcattgcagttttatcggtttttacatacttatttgtatctccagtaataccaagttctgcacctgtcttagcttctggagctactacatctgtctttttccatacgtcaaattttactcccgcaacttccacggcagaattaccaaaataattcttcaaatctccgattgaattaccattatatttggataaattttcttcataagtaaatttattgaaatcgtcattattcattacgattttgtgaacaataacggttgtgctagccgtatcttcggcatggactaagtgtttaatatttatcagtgaaccgagcaccgttaggaacacagtaaacactgaaaataatttcgtcaattttttcattgtatactcctatttttatttcttattttatttacattaggaactatctagtatatttccgacgttgctcaacggcaaaagcaatgaacatcatcaccccccctaatgcaatatatggaatgatacccataccacctgttttcggatattctcctttgcggaggtttttcacaataatcaggtgattgtccatattgtctagactgacgaggtcctctccatcttggatagagatagccccatctgcgccaatattaatatggaattctttctcaatcttttgataaccgtcaggggctactatctctttcaagatataggttttccctactgctaaattgtcaaagaggacttcatcccctgttgtagtcgttgtttttacaactgctgtcgcttgaggattgtcactttctcttagttcaaacgttgctacaagacgttgcgtaggatcgctataagaccgtttagcaagtttgatatgggttgtttgttttgtattcttcatgttaaagagaataacattgtcaccatctaccctttcagctaaggtaacctgattatctccattatgaagtttggtcgttccatcatggtttatctggaaacggtatttcttaggatttaattgatatcccgttggcgcaacagtttcttccaaaatgtagtaaccaaaactcaaagatgtttcaaagagaccatttgtcgtcacaccactagcaacttcagtatcctcaacaccatcgttgtttggatcgctgtaaattttaaatgttgcaccatttagaaggtgattctcgtcacgattatctgttttttggagtctgaacttaaattgcttgaagttcttgatggtgatctcaaaggtagcaccttgtgacgtatcaactgtcaccatattcgaatctgactctaaaatttgtaaactaccatctggtcggatttcaaatttggtatcttgtaattgattaacagggcgatagcctcccgtaggaacaactgtctctttcaaaatatagacgccaactggcaagttcgagaaggtgatactgttgtcagcactatttgtatcccccttcatattaacaccatcaattacaactggatgaccagcctctgtaacaagttcaaagcgcgcatttaaaccaagagtcggatggtgataatcacgttttttgattttaagattgtacctacgctcgttatttttcactttaatgctaatcgcatttgcaagagcaccactaacaccaggtaaatctgttacactaaccgaattagtttgacttaaaactctaaaacgtgtcacagctttctgttgcgttaccgcataagcttgcgttgtttcgtataactccaacaataccggtgcactcaaaccgtcataaccttctggtgcttgtgtctctacaagaacatatttgccaagcgctgtcgcagttaatcgtgtcaaactgctttgacctgtaaatgttaaggtttgtacgagattggtatcgtcaagagaggtacttgatacagttgcctctgttgtactatcgtcaactttatagagcttaaaggtaacaggttttgagatttgcttattattcgcatctactttctcgattttgaactctggattttcgatgttaccgattttaataacattagcggcagcatcacttccacctgcttcaatcgtttgggtagcatctcgaacacttacctgcaattctcggattcccaaccatctattcgttcccgtctgtagattccgtacacgaatgtattgagcatagatatctacagtctgagtaaggtcggtctcggtgaaattaccaattgattgataggtgataccatccggtgaatactcaagggcatagctatccatcttgtcatggtcactaccgtttgtggtatttttaccttgagcaaagcgaatttgcgttacgcgctgaggcgaacccaagttcactccccaccattgtccctcattcaaagtcgaacttgggagttggtacaaggcaccggttgtcaaatcaccgtccagcgccttatcttctgtactagagccataggtagaggccatagcaatctctgcagattttatcacatgcaaaccacgtgctatgtgactacttatatccgagtcagaatagaaacgcacgctgccatctctattaacataaatcgtgtagttttctgtcgatttgacatagccagatggagcttgtgtttctgtcagagtatagaccccaggctggaggttttcaaaaacaaagtcttggtttgcagcttgctgtttgacgataggggcaaagtttacatcgtcattctttgtcaaagtaaaggtcatttgtccagtgataaggttggtcaaatcactaatccctttaacacgcttgctaactttgaattttccgagtggatagttcttgacttttatcgtaatcgtatctggcgagctcgtcgtcacatcaataccttcaagataatcactattcacttctacgataccatctgcccgaatagtgaatggtaccaaacctgataagccaatataacccgatggagttttttcttctttgatatagtaagttcctggggtaaagtttttaggaaagctaaattctccattgtcaaagtttgcaatttgcccatcaattacattcccttggctatccgtaataccaatacgtgtctgcacagttactttctgtccagtcagtgcatcaattttctgcactttaactttataagttggagggcggttaataatacgctcactagtaccagattcaaaactgatagttccagtctcagataccgtaaatcgtgccgcagctgttgttaacttactataacctgctggcgcactagtttcccaaagttcataggttataccaccttgcaagtggtccacacggagcttgccttgactatttgaagttaagcctgttagaactcgtttgtagcctgtttgggttatctgacgaagctcaaacactgcatctgcgagtggctgaccttgctcatttaccttggtgaactcagtactaaagtcctcgtcaacaacatttatactaaagtttccgttgacaacttctaccgctcccgtctgtgtattggaagtgtctgttaatttacgtacttttaactctccattttcctcataaacctcaatatcaagaggaggaatcgttttataacccgcaggagcttttgtctccgtcaaagtataaatgccttttgcgaggttagagaaaataaactgacttgcaggaagaacatctcctattgtgacatcataatttccaccatttttactttgcagtctaaagacagctcctttcaatggcttactttcaccaaattcaaatttattgatttgaagtgtagttgatttagtattaacaacttctgttggcttattgacatcgtattttttcccatcaatggtaatattttgattatcggttacaacaatagtgtgctctgtcggatctaagatataaccagatggtgcactagtttccttgaaggtgtaggtgccgccgattatctccgaaaactgaatatctccattatcatctgaaactgcggttcgatatggttcatttcctttatataatgtgaaaatcgcacctgaaagtggaattttctgaccatttttaattccaacctttttcagtttaaaaccataccaatctacaggataagcaccaccttgtgatactgtatctccctcacgacgatagatattagtggttcttcctccacccataactggactattccatggtacactcataccattatagtacagaccatttttctgaaactttttccgttcttttagacggactacaattgctttattacctagtttccaaccttcttgataaaattcgattgtatgagtgctttcaaatccatcaaaagccggataagaatttctctcagaataaactcgaacagatattccaatatccgtacctggtaggtaataatggtggatattcccattatttgatgttcctttataagtgagcttttctaagctatccttagaataggacatagccttggtaccatctgctacatagagttcgatagattgaggaatactatttgctacatttccatttggaaacaactctaaacctggatgaagaaaatcataaaattttctcctattacctagacctcttaatcaatgtctgattgcgagtagtcgttgtataccactcgggaaggtttggaagcacccctgttttatatagttctgtagtctctctattattgattttgatcacattactggttggaactccaatctcaaaccaaccattgtactcttgtacggaataagcctctgtagtcagtacaaagcgaattaaattatctttttcgtgataaacttttgctatcaccttaccatttgcagacacagtggaccatgcaacattaggatttgcaacatgacttaactttaactctggtggcaattctaaagtaaatgaatctcctgcacgcgcaaaagcaggtattttcaagttcattttcatcgaaccgtcaaaaccaccccaaattttagaacctgatttatacatgacatagttgatgcttacaaggtctatactgcttaccccatagtttccgcaagtatctggtgggaatactggtgtcgtggtattatcctttttatttgtaaagacatagtaaagattttcccagtcagtctgtgcgctagaaagaatataacctgatggaacagcttcggtcacatcataatatatcctctttttagttgctgtgcttctcataccagaaaacttatcaacattagcaatcgtaatttgtgtattatttgcgctaagtgtttccttacgattagttaaacttcctccattaaccgtaaaggtcacgtctaccttatcactatcagcctcccaattcttctggatttttatatcacctttcagcgcttctagttgtgctcctgaaatggtgtgattaactttttcgtctttcacatttgtcactgtcttaaccaaagcgaccgcacctgccggaacattgtcaaccgtaatctggttcccaggcgtagcaaccttttcagctttagtttcagtataagttccattacttggttcatatatataaaccttatattcatgggcagcttgtgagctatctagagcaacatcaaatgtaaaactttgggttgtcgacgtatcatttagttgtgaactagtccattcgatgaccttatcgtcattatcacgatacttaccaattgtacgattggtattggaagtattgaccgtatctacttttaagtcccctagaggaccaccatcatttttagctggaagcgtaatagtatctgctgttgataaggtacgtgtttccttctgagttaaggtaactgatgtgccattataggtaagcttgctgccctttggagcatcaacagttacttccgaccgataatccaaactatagttatcacttggaatcaccacaggagtctcaatcgtatagacatacgtcccgtttccaactggtaaattatcggtagctgacttaaaattgtcgaaatttccgtagtaagtcgtattgggcgttattgcaactccatccttcatgatagaagtaattttaggttcacccaaaccagagtcagttgttgttgagaaggcatttctaatggaggtgatattgctattgacaccgcctaccgtagtagtgtattcccaaatgatttttgttgtattggtatttgagtcaaccactacctcttttttcttcaagacaccatcttgtgaatagctttgataaacacctggaattgaaattgtaataggtttaaaaatgtattttatgtttgactcttcacgcgtgatggttgttgttttattcccgaatacggtggtcgttgtagtggcatttgcatttcctgtcacagtaggattatcaagtaatgaagtatcaagtagcgaacgtgctactctcgctgaacgcggtatcaaagatgaatccaatattgagttcagcataagtccttctaaaggatttttaggggagttgctaattgagacggtttgtcttgattgagctactgttaactccactacttcttttgtggcagaaatctcatagccatctatggtagatttttgaattaccgcatagtttcccaacggaagatttgaaatcgttaggagaccatctttatctgtctgaccagtataaacaagattttcactttctacattacgcacctcaaatgtagcaccttcgatggcttcattttcagtatcctcaatgccctcttcttgttcagaactagattttgttaatttgatacagataactcctcgttgttcgaccaaagcatccaccgcttgctctgactctggaactgttgaacttccttgtgattctggattatcaggtacattttcttttgtttcagagacgggtgggtcttgagaaggacttactacattgacatcctcagtagatgaaggcttttcattaacttgagaatactccttaaagacactcggttcagctttaaaatatgcgatatgttccgcatctactaccgctactaactcccccttaataacctcactgaccttggtaaaacttaaagtcagacttacattatctgccgaataatccaattctgttgttggcagcagtctataggaatggtagttttctccatacactggaagttcttctacagtctttgacaatacatctaattcatttgaaagagagcgtttttctgtctcactctttgttatagctaggtccttctcgttatatgactcatctagtttccaacctttttctaaatcatctttctttaactctagccctttttgagtgataactactatacctttttcgttaaaattctgtgtagctaaactctgcttatctattgttattttttgacctatagtctttggactagacaacgattctactaactcaatatttaatctatctttgtcctcctttttgtcttcgatataggtgcgtcttattgttgaagcaccatcggtcgacaaactttctgccatgatatacatcgcatctgtaaaactatacgtgcatagaaaaaaaactgacattaaactagctaattgaactgctttctttctaaattctatcatctcgtactccttggtttgtgtctaaatctgctaaagttgagatacagggacattatctttttcggttctaaatataaacaaaatcaactttaatacttattaagcttacatgaaattgatagttcaaataccattatttcaatgcactataatataaatagcaatcgccgtaagttccctgcaatcttcctctagttttcactttttacaataacacttacacagattttttccatatacaatcttacttgatttccctctaaaatcaagcgacattcagcgataaacacagaaaaaatagaaaaagaacatctggaaatgacaaaaatcaccttaatataaaaatgaccatatttcaaaaaatatgcatcacaccatattacatttcaaacactgactctctaatgagtctaggacaaaaagatttgtttttttgaaatacctcatctggtcattctaccgattgataaacaaaacaaaaaacgaacaatactagtttctagataccttaaaactaattttgttcgtttttatatacaaatttttaatttttctcaaaatcattaatagactaattttagattcgattgaataaaagatgtagcttaaatatttcggcgacgctatttctgttgccaaaaactcggatttgtgagctattatatataagtctgtcctaaattgtttttcttgataaagaattcccgaactacttaaaaaggactttttacctttttagcctaatatgcatgaagaaaaaattactcacaggcaatctagcacaaataatagcgcagctaggtaaaaagtacaacgccacttctttaagttagtgtcaatatctcagtgcagtagttgattgctctagcaatctgagagaattgcttgaggttagaaattgaacaaacaaagtttgtgccgagacagcccaagaaactgtttcagcctgaccctagaaatcaaaagtgaggtaaaaaagttggatataggatttgtaaaaaaaatcacagcaattcgtattttatagtcttttaatttacttttagtacgaggcaatgagccgcaggcataactgaagttaggcaaggcgagttaacgaagtaataaaagaaaaactaaatgacgatacactcaaaatctaccctaatcagctatgtaaggatgagaagacggactctactaggaatagtcgtcttctcatccttgcctggttcttaattccattattgaaaccaatcaccatttaactatctataccccaataatcaaaggattctaacaggttcaagaaagactcaaacattccccatcgtcagtcccgactgatgccgttctttcagtaaatggccaaaccaagatcctagcaaacctgctagggcaatggccaaggtatttataatcgtccctaaggcaaacatggactacctcaacaattccgtcgcataactaatggtcgaaagagcataaagcggagctgtttccgcccggagaatgcgaggacctaggcctgtcttgaccgctcctgctccttcgaaagcagctacttcctcaggcgacacgccaccttctggaccgacgatgacaaggactgattggccgatttctaagccagacaagattttcactagattggcttgttcaccttcttttgcagcctcttcgtaggctaagataatctggtcaaagcctgctagttgagctaggaaatccgattttttctcaaacaagcgaacagccggaatgcgattgcgtttgctttgctcggctgcgccttgggcaattttttctaacttttctgctttttttgccagttttttaccgtcccatttgaccactgaccagtccgctggaaaggcccagagggctgacatgcctaattccgttgccttttgggcgacaaattcgagcttatctccttttggaaagcccatggcaatggtcacggaaatgggtaattcgacattatctgtcagttcttcgatgatttcaacagactggctctggctatccaccacacgcgccaagcgtttaataccgtcgtcaaataccaaaacaatttggtcacctgcctgcaagcgcatgacagaaaacatgtgcttggcagtgtccttatcgctaatctggaacatgccctgcggtgctctgccattgacaaaatactgctgcatcctagcctccaatcacacctgagcggtcagccgtcttcttaaagacgcagcaattccactcgccctgggtcatgtgagtctcaaggaagaagccagccgcctccgcagatgctcgcaccatgtcccacttatccgcgatgatgccgctcataatcaggtagccctcgtccttgaccagacggtaggcgtcctcggtcagatggatgagaatatccgccaagatgttggcaacgatgacttctgctttaatgtcaatgccacgaagcaaatcgcccgctgcgacatgaatattgctagtattggcgttaaggtcgatattttcctgggctacacgcaccgccacctcatccaagtcataggcataaatctccttggcacctaggagggagctagcgatggaaaggacacctgaacctgtgccgacatcaatgactgtctcgccaccacgcaagacctgagaaagagcaaagaggctcatcttggtcgtcgggtgggttcctgtaccgaaagccatgcctggatccaagcggataatcttctccccagctgtcgcctcatagtccgtccaagacggcacaatggtcaaatcgtgggtaatgcgagctggctcatagtatttcttccagttgtccgcccagtcttcctctgccaattcttgactttctagactgatctgacctgtttccaagccaaagcccgtcaaatccgccaagcgagtcgccaagtctgccttaacttcctcaatatccacagtatcaggatagtaagccgtaatcgcaatcatatccgactgctccacctcgggatagagttcgccgaaacagtcttcctgtcccacatagtcagccgagtcgctaatggccaccccctgactgcccgtttcaatcatgagatttgaaactgcttcttctgcatcacgatgcacgtgaatcgttaattcttgccatgagttcatgtttgttttccttttcttttctatcgtcaatcactgtattattgtaccgatttctagcccattttacaagttaatattacgcgatggagccctaataatactttttcgaaaattttctaatcgcactgcgaataaacatgtgtaggaaagtttgaaacggtggttccaagtttctgaacggaggtgatgcccatgaaagtggacagcaaatctgctagaaaggctagcccatgccagatggataagtaaacttactcatctggcatgggctagcctttctagcagatttgtctagggcacgcactagctcgagttttgaaaaatatcgtttcaaaactctcacgtcggaaatctctggatttatatttatcaggtctgcttgttgaaaggctgagcttgataatcgtcatcattttagctattcgagataaaaaataaccgtcagcaaactttgacacagttctgacggttatttaatctaacgaactgaaccaccgtttagcggtcctactgggcgttgagctggaactcaacgccttttctatttttataatagcaaaaatttcgcctgcagtcaagcaagagagaaaacagaatgtcaaatagaatctattaccctcaattctatacccactgcaccatactgttctaattgttctcgcgaataataaacttccatatcttctggtttcgcctctctgatactgctttgcgtatacccacaagacaataaatccagttctttgtataactgagcaaaattatcaaatatgtgaagctctaatacttgcacctcgatcgtttgcgtctgattttctgtacaataaaaacggatgcgatctccaatttgtatatgcttgcgcttctcgtcataaagtcgtagctcaatggtcttctgaccagacttcatcatttcaaaaggttttggagccagtaacatttcatgaaccatctcaatacctcggatatgggtaaaattccccttctaccaagtctgctttgcctttttcaaaagcctctccatcccaagaaatcgcaaattcttgggcttctgggtccgccaaaaagtccatgagatcatctaggccttggtctgcggtgtccttgagaaagcttgcgaaataggtcagaaattctgctgaaaagcccttcttggcgtcaaatggcagagcgaccagatagtcttcctcgtcaaagcgagacttgtcctggttgtagaaaaggacatactcctctaggaaaatatcctcagaagacgcattgccttcgtcgtccaccgtttcaatctcagccgcattttgtgcttccaagataaaagccaactcaatagcatgatttttcttgtcccagttgagctcgtaatcataagtaaaatgtttgtccagtgccgcttccagcacatctaaaaagccatgttttgccattctatttcctcttttctataaattccaataaatttatttctcgaccgtatttgacggaagcccgctcatctttctccaaaatggacttggttaaatctagttgatttaccgctgctaaggctacagcatagtgaataacatctgctaattcttctgccaaacgagcagagctgtcgtcttcgctatccatcatcttgcggcctgcacgttgattcagtagctctgctacttcaccgatttcttccactaatttcataaagagactttgctctggaactgtcgtcccatagtggtcacgcaagtattcttccaaaacactcactgtcaactccgtcatcttcgtttctctccaaatcctaaaattgtagtataatgattataccataaatgcactgaaaggaagcctatgccagccaatctcgcccttcgtatgcgacccaaatccattgatgaggtaatcggtcaggaacacctggtcggtcctggaaagattatccgtcgcatgatcgatgccaatatgctgtcgtccatgattctctacggtccgccagggattggcaagacctctatcgcctctgccattgctggcacaaccaagtatgcctttcggacctttaatgccacgaccgacaaccaaaaacgcctgcaggaaatcgctgaagaggctaagttttctggcggtctggttctcctgctcgatgaaatccaccgccttaacaagaccaagcaggatttcctgctccctcttttggaaaatggcaatatcatcatgattggagcaacgacggaaaatccatttttctctattttacccgccattcgcagtcgagtgcagatttttgaattacaacctttgcaaaccagccatatccgacaggccttggagttggctttgacagacagcgaacgtggttttgacttccctattaccattgagcctgaggctctggattttctggcaaatgcgaccaacggtgaccttcgtgccgcctacaattcgctagaactagctgtactttcgaccaaggaatgtgacgacggtagccgccacattgatctggacgccgtggaaaatagcctgcaaaagtcctacatcagcatggacaagaacggcgatgcccactacgacatcctctccgccctgcaaaaatccattcggggtagcgatgtcaatgccagcctccactacgccgctcgtttgattgaggccgaagatctgcctagtctggctcgtcgcttgacggtcattgcctacgaagacatcggcttggccaatccagaggctcagattcatacggtgacggcccttgaagccgcccagaaaattggctttccagaagcacggattttgattgccaatgtggtagtcgatttggctctttctcccaagtccaattctgcctatctggctatggatgcagctctggctgatttgcgaaagaacggtcatctgcccattccaaatcacctgcgagacggtcattatgctggtagtaaggagctgggaaatgccattggttaccagtatccccatgcctatcctgagaaatgggtggaccaacaatacctgcctgataagttacttcatgcggactacttcactgccaatgacaccggcaaatatgagcgtgccttgggcatgacacaagaaaagataaaaaatttgaaaaaaaatagacgccaaaatccttgatagaactggttttttggcacatacattttgacaccgcttacatttttgccatttttctcttgatttttcaaaaaaaagtggtattattaaatcataaataagaactgctgtggtatacgaattcatacctatgtgttgaccgactatttttgtattactagggagacaaagatcctctaacagtatgcaagctggcacacccagaagcaactaagttagaaacgcgtcacccacctgcttttagcgtgcgggatcaatacaatccatggataaccggtaccaatacagcatttttattttttaccttccttagctcagctggcagagcagcggactcttaatccgtgggtcgtaggttcgatccctacagggaggattggttgatatgaggaaagtcttgatttatcaaggctttttctcgtttttttgagtgaatttggtcaaaatttggtcaaaaagaaccttttcacattgtgaagggctatttttttaacttatcccacaggacaactcgtttttcctgtaatgatttctgtacatcgatgatgcgttgattcgatgagcctcgaaattgcagcataagattgcgcttggtacggtcataacggccgtcaactagaatatctaaataggatagtaactctaacttatccggagtttctaacatcatttcttcccatgtgtagcctgtccaagaccaaatgtccttttctggcagttctttccgaattcgctttacgagtgggaggaccgtgcccgtgttcagaaaaggctcgccacccaagagagttaggccctgtacatagggctgggccaagtctgctaaaatgcggtcttcaagctccttggtatagggaatcccagctttaaaagaccaggttgcaacattgtagcagccctcacagtgaaacagacagccactaacatatagagagcaacggactccttctccatccacaaagttaaaggctttgtagtccattattcgcccttggctaagttcctcgctcttccattcttgtggtttaggattattcatttcaaatacctgagcataagcaaatgaaatctgatcgtttggatgaattccgttttaccagtacacagactgtttttatccataaatggtacttccaatgctttagctcggattgatcccagcaagcttagtgcggaaccaatctcaattcctttcctgttttgattcagcagtttgtcactcccattaatcctcaatccagtatctttctactccgtctcgaacatcttccaaaacgccaccacaagccacaatcgtgcaacggctggcttgattgtctgtcaagcaagtcacaaggaccttggaaatatttttggttgcggcttcctgcaaaccaagtcgcagctggtccttggcatagccctttcctcgctcggttgggcgaatggaatatccgatatgaccgcctttattgagcaggaaatcgttgagccgtaggcgtagactgagaaaaccaagggctcgaccagtctggtcaaatgacacatattgaatggaaggaacaaaaccgtctggcagattgagacctgtctcatagtctttgtttctaaaaatccattcttcaaagtcgacatctttagagataaagcctccgtccatagctgagcctgctttttcaaattctgccagcatctccaaaatcgtttccttatccgctatagtcggtcttcttaattccattttagtctccatattgtcttttgaaaaattcactgatgatgtctatatccagtcccaagtcctgcacaatttctgccttgtggaaatcgtcatagttgtccttaccgctccaaacaaaagaattggtcacaatctgatagtccttatctgactcggctgctctgccattgaccacaaaaccctcactgcccgggacaatgccccacatctgagggtggagacctgtctgtatactggagagcaagtctctgcccttgatacgaactaagagtactcgcttggaaaagggcaagaccttgaccaagtccgaataaaagattggtcccgccgacaaggaagcccgaataccgaagccgttgatgaccgctccatccacctgcaaacctagttgactcgcctgttcaaataaagcctgacaaataacaggggccagagttgataacccttgacgaatgctgtctcgctctccgtctagtgcctgaggtaaaatcgctatcggttgggaaaaaactgcgtcacgttctgatttcatctggtcgataatagccttgaccgccctgtcttcttgggtcagtttctccacctcaatcaagtcataagccaggacctcgtgccgtccgtctgcataacaccgcagggatagatgaccgataaatctgccatattgcccagcctggcaaatactgacgctccctacttgagttggctctttcaagattgtatgagtatgcccacctaaaatcacgttgagttcagggaaatccttggccaaatgcacatcctcatcgtatcctagatgactgagtaagaccatatgagcctgtggatccttggcaagaacctgatccaccactcttcgtagagcttgtttatggccttcaaaaatcacattctccgacggtgacgcaacctcctgggtttccaaggtagtcaaaccgaggacatagagggggttcccattcatatcaaattcaaggacatcctcaagcagcaccaattcatcagccacctccacatcccgatagcggagattggaggacacaattggaaactgagcatagtcatccaagcgactaagcaactcatctccgtggtcaaactcatgattgcccaaggtcatagcctgacaaccaatttgattcatcagctcgatttccttgactcctcggtacatattgaaaaagatattacccgaaaagagatcgccgctgtcaaagacaaaggtcggaatacctttttgctcatttcgagctcgaatatccgcaatcagctgggctttctttggaaaattctccatgtaggaatgcatatcattggtatggagaatactaatatctgtatagtccatactattttttcttgttttttgcttgtttgagcaattcctgcacacgcgcttttttatcctgcttcacattagaattcttctcatgatagcgtgtcaccagggccttgcccttatcgtctaattgatattttcccattcttttcacctcattttcatttttgaacctgtgttcatttataacaaacttccacagctacctggaactgtggaagtcctatcttgtttatttatgatttacaaacttgacccgttcatgtgtttcacacgcgctgagatttccttgtgacggccttttaccatcggacgggcctgcggatttcctagatatccacaagttcgtttaacaacatccaccgacttaggatcgctattcccgcaatttgggcacttgaaaccacgctctgttggctcaaaatcaccttcaaaatcgcaggcgtaacaatggtcaatcggagtattggttcccaagtaaccaacacggtcataggcatagtcccaaacagcttccaaagcctttggattttgttgcagtacagggtattcacagtaatggataaatccaccactagcacctacagcaggataaattttctcaaaatccagtttttcaaacggtgttggatttttgcgtacatcatagtggaaactattagtgtaatactctttatccgtaatgtccttaacgatgccaaatttctctgtatccatacggcagaagcggtctgtcaggctttcagatggtgtcgaataaactgaaaaatgataaccatattcatccgaccaatcttcaaccaaggctttcattttcttgataatatccaccgtgaaatcttttgcctctgggttggtctcccattcgccaccgtaaaatacggttgcgacttcatacaaaccaatgtaccccaaagatacggttgctcgacgatttttaaagacttcatctactgcatctgtcttagccaaacgtttgccgaatgccccatattgatagagaattggagcattggccggggttgcctccttaacccgctccacgcggtaaaccaaggcatccttggcaatggccatacgttctgcaaagatttcccaaaacttatccttatctccagcagactccatggcaatccgtggcaaattgacggttacgacacccaagttcatccgaccagatgtcacatcctgtccattttcatccttccaaccttgaaggaaagagcggcaacccattggcaccttgaaggaacctgtcaactcaacaatcttgtcataagaaagcatatctggatacatacgcttggttgcacattcaatcgccaattgcttgatgtcatagtttggagaatctgactccaagttcaagccacgcttaactgtgaaaatcaacttaggaaagatagctgtccgcccttcgcgccccagacccttgatacgaatgttcaaaatcgctttttgaatttctcgctcaaaccatgatgtccctaggccaaaaccgagtgaggtgaagggtgtttgtccattggaagtaaaaagggtgttgatttcatactccaaagactgcatagcgtcatagatgtctttttgcgttttagcacgcgcatattcttcttgcttgtctgctaacacccaatcctcggcgtctttcaaatgcttttggtagttaagttccgcatagggcgccaaaacttcatcgatacggtcagctgagcagccaccatattgacttgaggccacattagcaatgatttgtgaaatctgagccgtagcagtttgaattgattttggactttctacatcggcatttcctatcttgaagccctgtgccaacatccctttaaaatcaatcaaacaacagttggtcattggtgtataagggctgtaatccaaatcatggtaatgaatatcgcctttttggtgggcattggccacatgagctggtaataatttgagaccgatagactttccgacaatacctgctgtcaggtcccgttgcgtattgaacacatccgcatccttattagcgttttcattgaccacagactggtccttgctcaacagcttatgaatttcaaaattaatatcggtagcctgatgacggcgaaaatcacggcgtgttcggtattgaatataaagctccgccaaatcatataaatgagcctttaacaattcctgttcaacgaccgtttgaatttcgtaaatttgaacatctttctcaaatcggcgaccaatttcagccaaaacagcttctaatacaatttttaaacctgcctctgaaacaggatgttctaattcttggtttgcccgctgaagagcagaaaaaatcttatcctggtcaaaggatactgtccgtccatcacgtttcaaaaccaataattctatactcggtaagacattttcttgcacattcatctgacaaacctccaaaattcttcacttctattagtgtagcacttcacaaaacaaaaatcaatatcttgtgtaaaaaaatattaaacaacctatccatgtactatatataggtcttaaaaattctatcaattggaaaacaactgtgcccaatttcaccactcgacaaggatgaattactagattgaaatatgaaaacagattgggcaaaggtctaacttctctatcagaaaacctaaaaaacagccctctaacagggctggctctatgtattgaaaataggctagggcgggtcacccaccaatgtcattaagttaactaacctatcacgttttgtggtaggttagttttttctatggtacactaaaaataaaaggggaaaagtcatgttagatcagattaaagctcacttacttgatagtattaacgacatcgtttccatcgcaaaccagtttgtgcttcatcctgaaaaagattttagtcggaaaagtcagctaactatggaaaccatgattcaagctatactgaccatgggtggtaataccttagccaaagagctacttgatttagatttgcccgtctctcaatctgcctttgtccaacgacggtatcagcttaaacatcaagcttttaaagccctgtttgccaatattacttctaagattccaacatttaaagatctccctatcttggctgttgatggtagtgatgtggttctaccaagaaatcgttctgataaaacaaccacgttccaaactggaccacaccacactccttacactctcattcatatcaatgctctttacaatcttgaacaagagatttatcatgaccttcgaattcagaataatcgggaggttgatgagcgtgcggctttcatcgacatgatggagagttgcccttttgaacaagctctggtgataatggatagggggtatgaatcctacaatgtcatggctcactgccaagaaagaaattggtcctatattattcgtattcgtgacgggaatcattctatgaaatcaggatttaacctccctgacaccccttgttttgatgaagagtttgacctaaacatctgtcgcaaacaaaccaatgtcatgaaagaactgtatcgagacttccctaatcagtatcattttttacctcataatgcttcctttgaccttttaccaaactctagtcgaaaaagtgatccaatcagtttttatgaccttcattttcggatggtgcgtctcgaaatcaagccaggtttctttgagactttggtgacaaatacggattattcaccagaaaaattaaaagatctctatgcctacagatggggcatagagactagttttcgtgacctaaaatacagtatcggtctgactcattttcatgcaaaaaagaaggaagggattctccaagaaatctacgctcactttatcaattttaatgtttgtaaatggctaacctcacacgttgctattaaaccatcaaagttaaaacaggcttataaaatttgtttttcagacgctgtttatgcctgtcgaaaatttcttagagaagaactcacttccttccaattagaaacctacattgctaagcatttatccattattctacccaatcgaaccttccaaagaaagataaaaagcaaggcacctgtaagctttacttatagaatatcataatagttaaaaaattgggttaaaaatcttcctttttgtgcgccctaaatacaaaaactattcccgttttgtcatcaattgctcagacgggaatagtttctttagctgcttaaatgcttaacttaatgacattgattctgactcttgttttctggtccataaaaagtacaaattgatggcacaggccactaaaatcacagcaggccaaagcaaatttaacaaaggaagtttaccgacattgtaggcaatatagagagtattccacactacccccaagctatagacaatcgtcaaaataattttcataagacactccaattaaatgatagtgctattatactacaaacgaccattgatgtccttaatctgccgttccattttccgatagtttaggaaaaatagcagagcgtataccaagacaaagatgagccagaaaaagagaagggccccaagtttcacgggaaaccagccagccaaaatgcccagcggtgtaaagcctaaaaccgtgaaaccaaaatgcgttgccgtcattcgtaaaaggctccaatcctgttcaaaaatcttgtctgccagctgaaacaagataccgattgtcgcccaaatggctacacaaatcaacatgacggttacttgactaaagttgctcaggtagtaagcacccatggttgaaaagggatttagaggaaggtaggttccctgtccgaagacggctgatgtgataatggagataatggttccgatggcgatgcctaaactggctgataagatgtattttttcatagtcctaacctttctttgataacttttagatagcgacgggaggagtaggtgaccgagccattcttcatgaccagtttgaccagaccgttagcagtcagtttgaggtggtccagttgcttgatgtgaatgatttccgactgagagatttgtaaaaagtttgccggcaagtcctccttaacctgatacaagcgtaggttggaagtataggtagtttctactgtttccacctgtaaaaccctatcttccaagtagagtctgacaatctcatcatgttccacaagatagacctgctccccttttttaacagttagactggatctctgcttatccaagttttgaatataggtcaccaagttagtaatttgctcagacatagcttgagcttcaatagtcaccaaatcttccaaaatctctgatgatatggctagttttactttcatattctctcctttctctttctgaccctattaaacaccatttctttactggtttcaagggcttttggctatgtggtcattttccagcactaaacggcaaaaaagccagaacaactgtcctgactttcattgtcttatatttttttcttcaactccgccaccgccatcatgacttccataggggtcatattgtagatgtctagtttttccagttcatcaagtactgggtgagaaggcgtgtctgcgaagagatcaagttgacctgacggttcttccactactgacggagctgggtgagttggtgcagtaggggcttggttttcaagcgtctgcaaaatccgatctgcccgctgcaatagttcctctggcattcccgcaatcttagccacatgaatcccgtaggacttgtcagctggaccttgggcaatcttgtggaggaaggtgacttggccgtccttctccaaggtcgatacatggacattctctaagtgttccaaggtctggctaaggtctgtcaactcatggtagtgggtggcaaagagagtcttggcaccaatcttgtcatggatgtactcgatgatagactgggccagggccataccgtcataggtggccgttccccgtcccaactcatcaaagaggatgagcgaccgatctgtcgccagacggaccgccttattggcctccatcatttcgaccatgaaggtcgattgaccactaaccaagtcgtctgccgccccaattcgggtgaaaatagcatcgaaaatcggtaattcagcctgatccgcaggcacataggaacccatctgcgccatgatgacgataaccgccaactgtcgcatataggtagacttaccactcatgtttggaccagtaatcagttgcatatgtgtatcggtattcaagtgaatagagttgggaatgtaggtctgcttgcccatgaccttctccaccaccgcatgacgaccacggtcaatggtcagttctctttgatctgtaaagcgtggacaaaccaaatgttgctgctccgccacaactgcaaaggcctgcaaaacatcgatggttgcaatggtccgagccagcttctgcaagcgacctatatacttctcaacctcttggcgaatccgcatgaaaatctcgtactccaaattagcagacttatcacgcgcctccaacatctgcccttcaatcttagccaactcttccgttccatagcgctccgagtttttcaaggtcgccttacggaaaaaatggtccggcacattgcccagattggaattggtaacatggaaatagtaaccgtcttttttattgtaatcaatcttaagattattgataccagatgcttcacgctccttggcctcaatctccgcaatccaacccgctccctcacgcatgactagacgatactgatccagcgtttcgtcaaagcctgtacggatgatgtttccatctgtgatggtcccttgggcttctgggtcaatagcagagctgatgagagcgtgcagttctgggattgggtccaatccagccaccaaattgcctagagcaggctcattgatttgttgcaagatattcttgattgctgggatatttcccaaagtctgggagagctgcaagagatccttgggcatggtttttccaaaagacacccggctggccaaacgttcgatgtcatagacaccttttaaagcctcgaccaagtcactccgttcaaagaagtaatccagaaaaacctgaacgacagcctgacgattctcaatccgcttaagatcaatcaagggacgatcaatccatgtccgcaatagtcgcatacccatggctgtcttagtttcgtctagcaaccagtacaaactaccatgcttcttgcctgtccgaccgttttcaagcaggtccagactggacttggttgcatagtccatttgcagatagtccttgatttcatagtggaccaccttttgcaagtggctcagatctcgcatctgagtccgatgtaggtagctgaggagtttacctgccgcagccttttccaagtctgtcaaggagttgtcaatcagctggacatcttccgtcacctcatcctcaaaagagagcaggaggttcatctggttcgaaaagacctgctcttcttcctcagataaagcatagccgatgaccaattcacgtgcccgtaaattgcggatctcaccgcaaagactagtaaaatcatccaaactagtcacaaaaaactgacctgttgacacatccatataagaaagcgcgaactgtactccctgacggtcaatcgcaaccaaatagttactgtctgctcccattttggacgagtctgttaccgtaccaggagtaatgacctgcactacttcccgcttgaccacgccgactgcctgcttaggatcttccatctgctcggcaattgcgaccttgtgccccaattcaacaagtgtgtcgatatactgttgtgccgcgtgatacggtacccccgccatgggaatcggattttccgcattcttattccgactggtcaaggacaattccaaaatctgtgccgcttctaccgcatcttcataaaataattcataaaagtctcccatacggaaaagcaaaaaagcatctggatactgtgcttttatatccagatactgctgcattcccggagaaattttttctgttgccatcatctctccttgttctaattcaaatagtagttaatctccgcttcaacttgctgagccgctacatcatctcgacaaataactaaaagtgtattagctcccgccagcgttcccaaaatagtctctggcttttctgcatcaatgatattggccatcaaggccgcttctcccagttctgaatgaaggaccagaataaaactagccctatctactttatacgcatattgtgccaataattggataaaattcacgcgctcttcttcgatagctaaggaataaaatgaacgcccgttttcatgaatttttatcactcccaactcacgtaaatcacgagacaaggttgtctgggttaccactacccctcgagcctctaaaccttgctgaatatccgtttgtcgccctattttttcttgacgaatcatggcctttattaaatcatgtcgtcctgctttattcatcattttacctcaaaatgtatatttatagaaatattataacacttttccccgctattagcctagaaatgtgttaaaatagaatcaataactttggaggaaatcctatatgaatcaaaaacaagtgattgcagaaagattggctgccatccttccgagtttggaagtggaagctatctacaatctgctagaaaaaccaaaatcatcagaaatgggcgatattgccttcccagccttctcacttgctaaagtggaacgcaaggctccacaggctatcgcagcggacatcgttgaaaaactcgatacaactggctttgagaacgttgttgcaactggtccttacgtcaacttcttcttggacaaggctgcgatttcccaccaagtcttgacagatgttattactgaaaaagaccaatacggtaaactcaacattggtcaaggacgcaatgtaaccatcgacatgtctagtccaaacattgctaaaccattctcagttggacatttacgctcaaccgttatcggcgatgcccttgccaacatccacgaaaaactaggctacaagccaatccgtatcaaccacttgggtgactggggcaaacaatttggcatgttgattgttgcctacaaactctggggtgacaaggctgcggtcgaagctgacccaatctcagaacttcttaaactctatgtccgtatcaatgctgaggcagaagaaaaacctgagttggacgacgaagcacgccaatggttcaaaaaattggaagacggcgacccagaagcgcatgaattgtggcaatggttccgtgatgagagcttggtcgaatttaaccgcatctacgacaaacttgatgtaacattcgacagctataacggcgaagccttctacaacgataagatggacgaaggtatccaaatcttagaagaaaaaggacttcttcaagagtctaaaggtgccaaaatcgttgaccttgaaagctacaatcttccaccagcccttatcatgaagacagatggcgctaccctctacatcacgcgcgatatggcaacagctatgtaccgcaagcgcacctatgacttcgtgaaaagcatctatgtcgttggtcaggagcaaatcaaccacttcaagcaactcaaagccgttttgaaggaaatggatttcgactggagcgacgatatgacccatatcaccttcggtctagtgaccaaggacaagaaaaagctctctactcgtaaaggaaacatcatcctgctcgagccaactctagacgaagctatttcacgcgcccttactcaaattgaagctaaaaaccctgaccttgaaaacaaggaagaagtggcacacgcagttggtgtcggcgctgtgaagttctacgacctcaaaaccgaccgtgacaacggctacgacttcgacttggaagctatggtttccttcgagggtgaaacaggtccttatgtacaatacgcatacgcccgcatccagtctatcctacgcaaggcaaactttgtaccaaacgcagaaaatgactacaaactggctgacacagaaagctgggaaatcatcaagcacatccaaaacttctcagctgttgtagaacgtgccggagacaaatttgacccatcacttattgccaaatacgctatcaacctagctcaagccttcaacaaatactacgcccacacgcgtatcttggatgaaagtccagagcgtgacagccgcttggcacttgcctacgcaacaggacttgtcctcaaagaagctctgcgtcttctcggcgtaaaagcaccagaaaaaatgtaatcaaagccttcggccatcagccgaggctttttttctaccacattgcctactctcgtttccgattccttatcacaacaactccttctcccaaatgaaaatcaaaaagattcatttcaattacgaatatatagatgggaggtacacgtgatacctctacatctactacacaaggagaaataatgaaaacattcttgagaagaaaaggaatcgcctgtcagcttctagccgccatttttattgtcggtatcaatttacaatccccaccttcagcctcagccaatgcaagaggagatgactatccctacacagcagttgatgcagtcgatccatggagactctacacacgccagtgcacctcctttgtagcctttcgacttagcacagttaacggttttacattgccacctgcctatggtgatgccaatgtttggggccatcgtgccaaacaagaaggttatcaagttaatatgacacctgctgtcggagccgttgcctggtgggaaactcccatgcatgtcgcatgggtttctgcagtaaatggagataccgtagagattgaggaatacaactacggtgttcgctatacctacggaaggcgagttatccccaaaaatgccgttagcggctacattcattttaaaaacctcggagcgggaacaaccaactctcaacccgccttagccccaagcggcacctatacctttaccagccaactggccatcaaatctcaagctagtctatctagccctaccctcgattactattatgctggcgaaagcgtccgctacgacaaggttcttgaagacgacggacaacgctggattagctatatcagctattctggagctcggcgctatatcgccatccagcctaccattactcaatctacaaacaacagcctaccagcatcaggtagctacaccatccagtcctactctagtgtccgcaacaatccaagtctgtccagtcctgaaatcaccttctacggagctggctcagtcgttcgctatgataaagttattactgccgaaggtcgcacatggattagctatatcagttactcaggtgctcgacgctacatcgccatctcctaatcacaaaaaatacaatatttaaaagcacaatcttttagactgtgctttttcattaaatatctgtcgaattaatagctgtgctcggtttttctttcggtttacgcagatggaagaagacggtcacaccaaagtaaatggcaaataggacaatgttaaggatgtaagcccctagcatacctgctgctgtcacatcacgcaaggctgcatctgagtagaggttggcaatccccttacctgctaggtagctataggtattcagcagtaaggtcgaaaatagatagccgatgtaaagataagaagccagctcatttttcttcatgaataagaagacaatgaccgcaatcaaaagaccaaacatgaccagggctgctgtcttttgaatgatacccgtctggagattggctgtttctctcgaaacaagaatcaattcttctacatcaatcccaacaactccctgcacagacgtacgaagtcgctcctcattaaaagtcgacacaaaggcactaaacagccttaaaatactggcaatactggatagtatcacaaaaatatacaaatgaatcggtcttttcataatagcctccttttttctatattttatactcatatttttatattgtcaatcatatatttcatttgactgcaaatataattttgttatactaagttcaaaggaggaaaactcatgaagaaattgcccacctatatcggagtgattatttttgtagtcactctactgattaactggttattgccaagtcttgctaaagtgctgaatacatttttcatttggactatcgtagcctgcctactctacaccatctactactggattcgctactggctctatgtccgacaacagagataacaaagactcctctaagttagctgcttagaggagttcattttattatgacttttcatcaaccaaatgcacattaacccgacgataagtttctgtaaggtctagcaattccgcttcaatctctggtgtcaattgatctgccgtcattctccaagtccagttaccaccaagcgtatttggcaagttcatgcgagctgaaccatccaaaccaagtaggtcctgcatagtagccaccgccataaaggcaggtgaaccaaagagcagacggaaaagagcatgactgaccgtttccccctcacgacgattgctgtacttatctaagaatgcacgcgattctttcgttgtttcattttcgtaccagccaagaatcgtatcattgtcatgggttcccgtatatgccaccacattattaggatggttatgtggcatttcaatgctgtctccttctggatcaaaagcaaactgcaggactttcataccaggaaaacctgtcgtatcacgtaattggatgaccttgtctgtcacagagcccaaatcctcagctatgatatttaagtctccgagttcacgtttgattgtatcaaataactcaaaacctggtgcttcgacacgatagccatttacagctgtttcttcacccgctggaatttcccagaaggaggcaaagccgataaagtggtcgatacgtaccatatcgtatatcttaaaggattcacgtaaacgagcaacccaccaagtaaatccgtcatgcttcatcgcttcccaatcataaatcggattgccccaaagctgaccaatttccgaaaaggcatctggtgggcatcctgcaaccacactcggcttgccttcttcatccgttttaaagaaatgtggattagcccacatatcggcagaatcagccgcgatataaatcggcatatccccaacaaactcaacacctttggcattggcataagcctttaaagccttccattgtgaaaagaataaatattgtgtaatgcggtgataatcaattcgatctgccaacaagtgacgataatattccaaggtatcgtggtaacgtaagcgcgccccttgatcttcccactctgtccaaggtttgagatcaaaatgctcttttatagccatatactccgcaaaggtatgaatccaaaagtcattctcccctaagaacatccaataatcttctggcaagccttgtgccttcatgttggcaactaccttctccagtaatggacgtcgagcataaaaaatggctgcgtaatctacctctgtaggattctgcccaaagtcaacaccgtgtaaatcctctgctgccagccagcctttatcaatcaatatatcaaaatcaataaaatgagtattccctgcaaaagctgaaaatgactggtaaggagaatctccataactggttgttcccaaaggtaagatttgccaatagcgttgcttagttcttaccaaaaaatcaacaaattcataagccgattggcccatggaaccaattccatatttcccaggtaatgatgaaatgtgcatcagcacaccactctgtcttactttcataagttctcctatctaatccgcttgcacaacgcaaacgttttctcttttttattatatactgaaaacggtaacaaatcaagaaatttccatttaattctgttagttcacatgccattccatatttcttttcattaatatatgcaaaaaaattcttatatttttttaaactcaaaaaaatttttaaaaatttttataaaaacgcttgcaaacggattcaatctagtgtataatgaagtcaacttaggaaaacgtttgcgcaaagcaagcgtcacacaaaactatttatcttcggagggaagaaaatgaaacacaatctccttaagagcgttgctcttcttgctgcatcaactgctgttttagctgcatgctcaaactcaggttcatcaacagaggcatctaagtctgctgaaggtagcaaagaattgactgtctacgttgaccaaggttatgaatcttacatcaacgatgtcaaagctggcttcgaaaaagaaaatggtgtatctgttaccgttaaaactggtgatgctttaactggtttggataacttatcgttggataaccaatctggttcagccccagacgttatgatggcaccatacgaccgtgtaggtagccttggttctgaaggtcaactatctgaattgactcttgcagatgatagcaaagcagatgacacaacaactgctcttgtaacaaacggtggtaaagtttacggttcacctgcggttatcgaaacacttgttctttactacaacaaagacttgttgactgaagctcctaagacatttgcagaacttgaaacacttgctaaagacagcaaatacgcatttgctggtgaagagggtaaaacttcagcattcctagctgactggacgaatttctactatacatacggacttctttctggttacggcggctatgtattcggtgaaaatggtacaaatccaaaagacatcggacttgctaatgaaggtgctatcaaagcaattgaatacgctaaaacttggtacgaaaaatggcctcaaggtcttcaagacggtactgctgcaaacaacttgattaacactcaatttacagacggtaaagcagctgctatcatcgaaggtccttggaaagcagcttcatataaagaagctggtgtaaactatggtgtagcaacaataccaactcttgtaaacggcaaaaactactcagcattcggtggtggtaaagcatgggttgttccagcaggcgctaaaaaccaagaaatggctcaaaagtttgttgacttcttgactgctacagaccaacaaaaagcactttacgacgctacaaacgaagttccagctaacactgaagctcgtgaatatgctgtaagcaaaaaagacgaattgacaactgcagttatcaaccagtttgcttcagctcaaccaatgccaaacatctcagaaatgggttcagtttggacaccagctggtaacatgctcttcgaagctgcaagtggttcaaaagacgctaagactgctgcaacagacgctgtgaaagctattgcagacgaaattgctcaaaaacacagcaactagtcaagtttaaagttggactgggagttctcttcccagtctactttattacttaacgataaactgaatagatatagtcttttagtttacttttagtacgaggcaatgagccgcaggcataactgaagttaggcaaggcgagttaacgaagtaataaaagaaaaactaaatgacgataacatccaccgtctattcagaagctatataaggagactatgactatgaaacaaaatccaggtaaggcactccttttgtccctgatccctggtctcggacaaatctacaataaacaaaaagccaaaggatacatctttttaggtgttacgcttgccttccttgtttattttattgctattgcagctggtgaattaggcaacttgattaccctcggtagtgttcgtggacaagataattcgctattcatgctgattcgtggttctttccacttaattatcacagttgtctatctcgctttctatgcactcaacctaaaagacgcacgtgataccgcgaaacgatggaattcaaggatgccagtggctaccacattaaaagaaatggtaaaaggtatctatgagaatggtttcccatatctcttgattatcccatcatatattgcgatgacctttgctatcatcttcccagttgtcgttacattgtttatcgcctttacaaactacgacttcaaacacctgccaccaagcgcattgttggattggattggtattaccaactttacaaatatctggaaactaagcacattccgtacagcatttggttctgtacttggctggacaattatctgggcactctgcgcttcaacagctcaaattgttatcggtatcttgacagccatcatcgcaaatcagccattcatcaaaggaaaacgcatcttcggtgttatcttcttgctcccatgggctgttcctgccttcgtaactatcttgacttttagtaacatgttcaacgatagtgttggtgctattaacacacaggtattgccattcctgagcaaattcctaccattcatcgataatttccttatcccttggaagaccgacccattctggactaaagttgccctcattatgatgcaggcttggcttggtttcccttatatctatgttttgaccctgggtattttgcaatccattccaaacgacttgtatgaagctgcttacattgatggtgcaagtgccattcaaaaattccgtaacatcacccttccgatgattttagcagtagcagctccaacactaatcagtcaatacaccttcaacttcaacaacttctctatcatctacctcttcaacaatggtggtcctggtagcgtcggtggtggagcgggttcaactgacatcttgatttcatggatttataaattaaccacaggtacatcacctcaatactcaatggcggcagcagttacattgattatctcaatgattgtcatcagtatttccatgattgccttcaaaaaactaaatgcttttgaaatggaggatgtataagatgaaagtatctgtaaaaactagacgcatactcaatcagaccttaacctatctctatctgattgttctgtctgttatcatcatctatcctctcttgattacaatcatgtccgccttcaagtctggtaacgtggttgccttcaaattggatagcaatatcaactttacactagacaattttagcaagctctttagcgagactctatacggaacctggtacttcaatacgcttatcattgctctcttgacaatggttattcaaacaagtatagtggtactagcgggttacgcttatagtcgctataacttcatcgctcgtaagcagagtttggtcttcttcttgattatccaaatggtaccaaccatggctgctcttaccgccttcttcgttatggccctcatgctcaatgcgctcaaccaaagctggttcctcatcttcctttatgtcggtggtggtatcccaatgaacgcttggctcatgaaaggctacttcgatacggtaccaatctcacttgatgaatctgcaaaactagacggtgccgggcacttcagacgtttctggcaaatcgtcctcccactcgttcgtccaatgattgctgtacaagcgctctgggccttcatgggaccttttggagattacatcctatccaaattcttgcttcgtgaaaaagaattctatactgtagctgtcggacttcaaaccttcatcagtgatgtgaagaatatgaagattgcctactttgcggcaggtgccattcttattgccctccctatcagtatcctattcttcttcctacaaaagaactttgtatctggtttaacaagcggtggcgacaagggataaccctgtcccaccttttccctttttaggggaaacattgatatttatgaaaggtccaacgaatgctcccatatcctttttcctatttttctagtatcttctctccaagaaatatgtttgccaatcgtagactaatgaacctttggcaacggttgtttacaacgctttttttagtggcgctcttgctcattccgagctccctacagactgtcaatctcgaaacctatcctttagaaaatttcgtagaaggtatctatgcacctctgacagatcaagtcgtagatgacctccgtcaacatgcagtcatcgaaaacaaccacctaacctatactggaaatactaactgggagcaagtgacatttggtgataccgttagctctagttctgactttacttatcaattcgccaatcagtctctgactattcgtaaaggaagtgatattctaagcgaattgacttatgaaggtttgaatactgacgattttgctagtaaggagaccttgactgcaaccatctctaaaaaatggtatcaagccaaccgagcagctgtcggactgtccatcactcttatttcgacctttattttaacaacaaacctactcttcatcctactaggagccagcttcttcctctttttgactaaaaagtctcgtttcttccattttgaaacgtttgcagagtgctataattttgctctcaactgtctgggcctgcctactcttatagcctgtctaattggactatttggtcaacctgtgactacccttctaaccatacaaaatatcctatttgtactatgcttgttatgggtatttttcaaaacaaaattcagagatgaaatctaggaggtctatatgcgtgctaccatcaaagatgtggcaaaattagctggtgtctcgccatctacagttactcgtgtcattcaaaatagctctgccattagccaaaaaacgaaagacttggttaggaaagccatggcggatctcaactaccatccaaacctcaacgctcgaagcctagtttctagctatacacaggttatcggactggttttgccagatgactcggatgttttctatcaaaaccccttcttccctactgccttacgaggaatttctcaagttgcggcagatcataattatgccatccaaatctccacaggaaagaatgaagaacaacgtctagaagcgatttctcagatggtctacggcaaacgagtggacggcctcatcttcctctattccaagcccgacgatccattggtacaattagctatccaacacaaattccccttcctcattcttggtaaggcggattctccattcatatcactagttgataatgataatatccaggccggctttgaagctaccaactacttcatcaataaaggttacaaaaacattgccttcgtcgctggtaacaaagagttagtcgtatctcaagaccgttatacaggttacaagaacgcccttaaatcgcacaatattcccctggatgaaaacaaggtcaagtttgtgtctggcttccttctcgaagacagtgcctacaaaatttctaagaaattactcaaacaagacctggatgcaatcgtcacaactgacacttccgttgccgaaggtgttgtcaaatatctcaacgaagtcggagtcaaacttcctatcatttcttttgactccgtcaagccaaaactagatattgaagcctacgttgacgtccacgctattaaactaggacgcgtcgcattcaacactctgcaccaaatcatcaatgacaacaaggaagacaagcaagtctgctaccgacgtgtcattccacataccattaccgaactctaacttagaaaggagccttttggctcatggcattacgacaatttcaagcatctcttgacgatgtagcaactattcgcttggtcatggaaaaacgattcgactccgaacatatgagcttctcacttgaatcaaatgatgctacatctcaactttttatccattcctgtctagaagtagataatctcgtcatctattatctaaccagcctccatgcactgacattggacaaggactataccatctacgaccaagaccgtaataaaacagaactcggctatggtcatatcgttcgctctacactttttgaacaaagttatacatacaatggccaagatttgggagcaacctatcgaccagaggcaacaacctttaagttatgggcacctatttctaagcaagtttttcttgttctagaaggaaacccacatgcaatgacgaagggagcaaaaggagtttgggaaattactgttgaaggagacctagaagcgcacagctatcactatctccacaaagtaaacggtgaatggatttccgttcacgatccctacgccctgtcttccacagccaactcaggtgacagctacgttatcaatccagataaacttcataaaattcgtcgtgctaagacccaacgacctatttctcaggccattatctatgaaatgagcgtccgtgatttctcatggcaaaaagaagctggtttcaagcatcgcagtcaatttctcggcttgacagagtctcctaccatggatggaatgaagctaggaatggattacatcagagaactaggcgttacccatattcaattattgcctgtttatgattttggcagtgtggatgaaaataaaccccaagctgtttacaactggggctacgaccctatgcaatacaatctgccagaaggttcctattctagccaaccaaacgatccttacgcacgtattctagagctacaagaagctatccaggcctaccatgatgcagatatttcagttattatggacgttgtttacaaccacgtctatcatgctgaaaagtacgcatttgagctcatcgttccaggctacttctatcgctatgatgaccacggcatgcgaacagacgggacattctgcggtaacgacgttgccagcgagcgcagtatggtccgcaactacatcaaacaatcccttcgccaatggctagaactctatggttttgatggcttccgtttcgaccttatgggtattttagatagcgaaacaatcaaccagattcaaactgaattatctgccattcacccaaatgtctacctctatggtgaaggatggaaaatggcaacaggcctcgaatttgaaaagctggctcaccagtacaatgcagagcatttacctgaaatcagcttcttcaatgacgattaccgtgatacctttaagaaactcttgctcaatccaaaccgtctaatagataagcaattgcacgaaaaggtacaacatctcctgactggtagccgattaagccatttcttaacgcctcaacagtccctcaactacatcgaatgccatgataatgctacagcatttgactatttccatattgagaatccaaactggacacctcaacagcagaaacgtgctgcaagttttggtctccagctcatcttaatctctcagggtatggccttcattcacagcggacaggaatttttccgtacaaaagatgaaatagataatacttacaatatccctgaccgtatcaaccgtctggactggacacgagctattcgttataaggaacatatcgagttcattcaggaattaattaccttccgcaaaaataatccaatactcagccaggataactacgaaagtatccaagaaacttgtgatttctactggttaactgaatatgttcttcgctatcaagtgacaagtgaagaaaagaccattcaatttatcatcaactttgcagatagcgactttacctatgaacgtgaaaaagataaggcagttctctacaactatcctccagtcgaagagcgtgatcagcaagaaatcacgattgcaggacagagtatttgcattttagaagacaaataggactttagaccgatgaaacacgatatagtctgaggtatactatagtcaatcctaaatatttttcataatctccttaaaactcactagtcactctggtgagtttttttttgtgtgaccaaaaaaacaacccagcataaagctgagttgaggctctttacatcaattccattatcttccgaccaatgcgttcaatgtcattctgcatccctctgagttcaaaggtgtctataacaggaaaattaaatcgctcagcatattgcttggcagtcagacaatattggttgttaaaattgcggttacctgagccaacgacacccagacagagctctgcattggtccccaaagcgataaaatctccaagaggattggtcagaatttccacatctccgttgtccactccatttccaccttctaagtaggttggtaaaaaggcgacaaagggtgcatctagctgatagaaaggaatagcctgcttgaccaaatctttgacatgaactagctcaatctcccagtcagtttgaaattggaaaaaggactttagacgtttcacaaaactctctgtattgccactcaaactgatgtaaaccaaatatattttcttcttcatacacttcctctttataataaaaacactacatgtagactgtaaatactattttactcctacatgtagtgtttgtcaatcagtcgctttccacaaaccgaccaataatattgacgttgtcagctaccgatacaaaggctttggggtctgcctttttcataatatgcttgaaatcattaaactccgcacgagtgatgatggtaatgagaatcgtcttttgctcatggttataagcaccctcagcaccgttgataatggtcacaccgcgattgagcttcttatggattttcttaatgacacgttcaggatgattggtaataatcatggcctgcatccgtttttgtttcacgaaaatcgcatctgtcatgcgactggagataaacagcgcaaccattgaatacagggcatattgccagccaaaggtcatccctgcaatcaacataatcataatgttgacaatcaaggaaatagagccgacttgtcgtcccgtcttcttgcgaataataatagagacaatatcagtaccaccactggatacattgttcctaagtgcaaagccaatcccagttcccagcatgagaccaccgaaaatagcattgactaacggatccgtcgtcagggtaactggcggcataaattggataaagaaagaactgaaggataccgtaataaaggtaaagatagtaaatttataaccaattttataccaagctaagataagcaagggaatgttcaggccgtagtagaccaccgcaatcggtacattccaaccagcgtaagaagctgccagagcagaaacaatctgtgcaagaccagtaactccagacgaatagacattccctggtcgaaagaaaaaattgactgcaatactagataggagtccataaataatggaccccgatatccgttcagcatatttttcccgagaaattcccaaaatgaccgaccaaaacttattctttctggcctttcttaaaaagcgtacacgctgttttctgaaaaatttattcattttcaagtgtaatgtctaaagccaattcctctaattgagctgatgcaaccgtacttggtgcctgtgtcatcggatcagatgccttgttattcttcggaaaggcgataacttcacgaatgttatcctcaccagccaataacatgacaaagcggtccaacccgatagccaatccaccgtgtggtgggaaaccgtagtccatagcttctagcaagaaaccaaactgctcatgggcatcttcagctgagaaaccaagagccttgaacatctgttcttgcatgtctttttggttgatacgaaggctaccgccacccaattcataaccattcaaaacaatatcgtaggcaactgcacgcacctgcgccaaatcaccatccaaatgatgagctgtttcttccgtcggcaaggtgaatgggtgatgggcactcatatagcgaccttcctcttcagaccactcaaacattggccaatccacaatccagaggaagttgaacttgctttcatcaatcaagccttgctcttttgccaagcggttacgcaaggctcccagggtattgttggctacttccaattcatctgctacaaagagaaccaaatccttgtcttccaactgtaaacttgctgtcaatttttctgtaatacccgtcaagaacttagcaactgggcccgctaattctcccttgtctactttaacccaagcaagtcccttagcaccaaattgttttgcgtagtctgttaatttatcaatgtctttacgtgagtagctatccgccgcacccttgaccacaatggctttgacaactggtgcttctgagaagaccttgaagtcaacttccttgacaagttctgtcaagtcttgcaaaagcatctcaaaacgagtatctggtttatctgaaccgtagaagttcatcgcatggtcataggccatacgtgggaatggcaaggtcacatcaattcctttggtatctttcaagaccttagcaatcaagccttctacgatgtcttggatttcaacctcattcaagaatgaggtttccaagtcaacctgtgtaaactcaggttgacgatccccacgcaaatcttcatcacggaaacacttaacgatttggtagtaacggtcaaaaccagcgttcattaaaagctgcttagtaatctgtggactttgtggcaaagcatagaaatgacctttggacacacgagatggtaccaagtagtcgcgcgcaccttctggtgttgacttggtcaacattggtgtttccacatcgataaattccaaatcgtccaagtagttgcgaatgctgtgggttacagccgcacgtaatttgaagttgttgagcatttctggacggcgaagatccaaataacggtaacgaagacgggtatcatcactggcttcaatgccgtccttgatttcaaacggagttgtcttagccgtgttcaacactgtcaagctggttacttgcagttcaacagctcctgtcgggatattgtcgttagcttgctcacgctccacaaccgttcctgttacttcgataacaaactcggaacgaagactctccgcttttgccatcacttcagcttcaactgactcagggttaatcaccaattgcataatgccttcacggtcacgcaagtcaatgaaaatcaggccacccaagtcacgacggcggccaacccaacctttcaaagtaatttcctgtccgacatgctccttacgaacacgtccagcgtacatagaacgtttcattttcttcctcttttactgattttatacctattcattctaccataaaatagctgatttttgggagaaattgccgagaaaaaatcgaaaaaccagccctagttgactggtttgatgtatagcatatccaaatgcggaatatcatcctccaaatatacttcagaaactggcttaaagctaagtgattgatagaatttttctaaataggcttgggcaccgattttaatctgactttctttccattcatttgtaatgtaatggatagcttgctccatcattggccgacccaatcctttaccacgatggcttggcttgatgaccacacgaccgatggaaacttcatcataacttataccagccggcaatattctcaaataagccactaactctccttcatcagttcccaaaagatgaagacagtttggatcctttccatcgacttcaggatagggacaagcttgttctacaacaaagacatcggtccgaagtgtcaagatagtgtaaagttcttgtaaattaagttgttcaaatgtttttatttcccacttcatatattcctcctagggcagaatgttgcctgcacttttgtaaatctcgtaccattctggtctggttaaggtaatctggctagcttgggcaatctttgtcaggcgatctggattcatagaacctacaatcgtttgaatctttgctggatgacgcaaaatccaagctacgacaattgtttcatgtgaaacattgtatcgctctgctatttccccaatagtttgatttaaatgagcatagtcaggatggttggcaaaaatacctcgctgcaaatcaatcaagaaaggagaccaagcttggatagtgatttttttaagctggcaataatcaatcagtccaccatcacgcatagtcgcagcatcatctttcatattgacatgtaatccagcatcaatcaaaggcgtgtgagcaggagatagctgcaattgattaactgcaagcggttgatcgagataggattgtaataactccatttggtaaatgttttggttgctgacgccaaaatgatgaaccttccctgcttttttcaagagataaaaggcttcagctacttcctctgcttccattagagcatccggacgatgtaagacgagaacatctaaatattccgtatccaagcgcttcaaaattccatctacagattccaaaatatactcttttgagaaatcaaaatagcctttacgaataccacattttgattggaggagcatgtcctcacgtttcaatcccgccaattttgccccctgagcaaaacggatttctgattcaccaccaccataaatatccgcatgatcaaaaaagttgattctttgctcaaccacggtttccaataccttggctgtttccttctctctcaaacttgccattcgcatacagcctaaagcaattcgtgaaacttctagacctgtttgtcctaatctttgcatttatcttctcctttgtaaacgcttttcatattccttattataacagaaaaactcagccgaaactgagttttagttaaaaccataaattcttttcgcgattttatagacggcattggaaatttttcgacctgggtaaccgtaaaggttggttaattgcccgagtaacccttttcgaacgattttaaatagagctggattattatcccgaatatagtgccagagttcctgctttttcatcatatgttcagctgttccagcacgattgagaagagcacaggagataatggtcgtaatctccacatgattgagcaaataacttcgtaaatcaggattgtcaatcgcctccaagtctaaattatctaccaaaattcgattgacttttaactgctggtcaatgcgcttaatcatgacggattcattgacagactggtcatttcgcccaataaagtaacgataaaaatctactggcagatagaacatagttttcacagcctgcaaaggagtaaatacgaaaatattatccacatagaaggtatgctctggcagaacgagaccaacctcacgcaataaatctgtcctgtaaatcaaggaatgcatcatcatgtattgccccttggaaaaggcatccacatcttcccagccaaaaatccgattttctggtaaaacatcctgataagacatggattttttacgagattgtccctctttttcgtaaacaaagttggagataaaggcatcaactggcgtattttcatcttccaaagcctgcaaactctctaggatcttcaaataggccctggtatcgacccagtcatctgaatctacaactttaaagtacttccccttggcctcacgtatccctgtattaacagctccgccatggcccttattgtcctgataaatggcacgtacgtttgaaaattgattctctagcccctctgcgatttcctgagtccgatcggtcgacccgtcgttaataatcagaatttcaaccttgtcaccgcccattacaagggaatgaacacagtaatgaaggtaggcttccgaattatagctcggtatggcaatgcttagtaaggtcatctttctctccatttgacacaatttgttactattttatcacattttcaggaaagttgcttttgatattttctttttgcttgataggctctccatagttggcctaagcccttgaaaaaatttccattgacaatggttagaatcccttccaccatcggtaaatcgagcatgtctcctgtcatctttgccattgccctaaatggcatattataaaggaacagcaggttcaagtcaggagtccctttctgctctgcttttttcagtaagccagccaacagtttatgcacgccacgtgccaacccactcttcgcaaattggagtttcaaaactggatcgttcaggctcagttcttgaccaattttccaggtttcttctggaactggacgtccaagcaattgtgcaaaatcctgctctgaaacagcctgcacttgggctgtcagataagtcggaatctgttctgaagcaggaaattggtctacagtgccttctcgggtaatctcgccaactaagcgaatatcctgactacttgcacctacatacaagagataatttccagcctctacttcaaattggcctgtctctttattaaaataacgaaacgtatagtcctcaaaaggaataaaaatctgtttggactcgcctgcttttacatatacttttttaaagccttttaactcctttgcagggcggtaaatctgacgaacttctttgcctacgtacaattggacaatttcagcaccatcaaccagaccagtatttgtaatagtgactctgactcctaattcggtcacatccaattgactgtaagaaaagtctgtgtaggacaatccataaccaaagggatacttgacagtcttgtcaaggcttgtaaagtaacggtagcctacatagagagcttccttatagagggaaaaatcgccttccgctggatagtcatccgaagatggaacatctgcaagattaataggataggtttcgcttagttttcctgatgggttgacacgtcctgtcaaggtatctaaaatggctctggcaccagcttctcctgatagatagccgtgaagaaccgcatctacatccacatcccaattcatatccacaactgagcctgctgataggacaacaacgatttttttacctgtccctaccaaggcattcagtaaggataactggtttttagggagacttatatgatgacgatccaagccctcactttcactcatttcatctagccccatatagtaaagaacaagttccgcttggtttgcaagattgacagccctgtcaactaacaccctgttttctttatctacacgttgatagccttgttcgtaaccaatgacatttaatggataatctgcgatgcaatccactgttttatctaattgtcttgtattgattaaagaagaacctgctccctgatagcgaggattttgggcaaattctccgatgagagctatttttgtctcactagataagggcaagatctgatccttattttttaatagcacaatgctctcagtggcagcctgacgggccaattcatgttgttcagaataatctacagattgtttttcagcatgagccaactctaaaactacatcaatcagctcatccacgcgctcattcaatacttgctcggatagacgaccagactgaacagcgtgaatgatttccttttgaccaacctttttagtacctggcatttccaaatgactaccattttcaacaccgagaacatggtcattggagccaccccaatccgatacgacaaagcctgtaaagccccattcatcacggagaatgtcacgtaagaggtgcttgtcttcattagcgtagacgccgtttattttgttataggcagacatgattgcctttggatttccttcacgcactgcaatctcaaatcctgtcagatatagctctctcagtgtacgctcatctacaatggagtctgaagccatacggcgcaattcctgactgtttacagctaaatgctttggcgttgccgcaacaccttgcgactgcattcctcggatcattgcggccgccagttttcccgcttgatatggatcctctgaataatactcaaagtttcgaccacataagggactgcgcttgatattaagccccggccccaaaatgacattgacacccaagctatttgcttctgcgccaagaccctgtccgacacgttcaaccaggtccacatcccaagaatttgccaaggtagcagctgttgggaaacaagttgcagggacagaggcattcagccctaagtgatcaccttcaccttcttgcttgcgaattccatgtggtccatcagacaaaaagatagatggaattcctttttcagggtaatcctttgtttcccaaacagattttcctgacatgagagctgctttttcttccaatgttaaacgattaataatctcctgatacttcatcatcttttcctcattctatttctttatcactatcatatcagactaaagggacaattaaaacgctttcttcataatctgtatgattttggacataatctgctataaaaaatctccccagaaaatactagggagatcgctcctattacttcttatactcaatgaaaatcaaaatcaggctagctccaacagtctgagaatagactgttggaggtgggagataggacgaacctagttcgtttctatatgagcagatagaactctgtcgctttattattgtcaagcgacaggctggaaacctccactggaactttccactcatcaaatcaagccaacaacggctgagtttgattttcgaagagtattatttcatgattacaaacttcatcattggatagttgacagccacttgaacgaaaatattgacccagttggctgctgtctgtgcccagcccaagctcaagccccatgatgtaaagagttgagtggtgtaaggcggcagcacaatggacaaaattcctgcaacgacaacagtcaagatataccaatggagggttttggatatatcgttttctgctccgaataccaacttcctttgaacaatatagttgacaacctgtgccgctatgtaagccaagaggaaggagagaaagccgttcaatccgccattttctacggaataatgaaagataaaccagtgaaatggctgacttgacaaggctgtaaagaggaaattggttgacaaccaaaggacgcagaagtttgtaatagttgcgatgtttgataagacattaaacttgataaactcccacaaatctgggtgtttggcaatccattctttcatacggtctcctatgcaagacaagggggaaatcccccttgttatgctacttctttttcttcttttttcttacctgtcaacttaacgagtccaagacctgtcaagccgataagggcaatattacttgctaccaatacaacaatccaccattttgtttttggtttatagatgtcaaaggctgcagaatgagcaacggtgtacaagatgttcttacttgcctgacgaagtgctgcaacaccttctttagtacctgttgaggttgctgtcggtgcatcacctactggggttaacataaggtcgccaccattgcggattgcttgatctggactcatgtagtcttgaccgtcaaagtccgtaataaccattcctctgaagccccactcgtcacggagaactgtattcaagaggtcgctattaccccctgcccagagggtaccaatacggttaaaggatgacataatagcagtcgctccgccttctttgacaggaatttcaaaggctttcagatagatttcacgcattgcctgttcatttgaccatgttgcaacaccttctcggttatcttcttggtcattgagagcaaagtgtttggtaaaagtatagacaccattttcaagagcttttgctaccagtgagcttgccattttacctgaaatcagtgggtcttctgaatagtactcgaagttccggcctgagaatggtgagcggtggatgttcactgcaggagcatatagaccaacaataccgtgtgccaatgcctctttagcaaaagcatcacccatttcttccgccaagtcggtattccaagtagaagcaacaacgacttctgagttgtattggatacctttgataccttggaagataccgttgataccagcaggtccgtccaagtcaacaacagctggtttatcgattgatttgactgctcctgttgcataaccaccaaagccaaccaagttgaccatttcatcaacagacatttgagcaactagttgttcccaacgctcatcatcatagtttgcaccaatcaaatcaaccaaacgaagtccattgtcttctgttgtcacagtatcaatcggtgtttcagatgattcgtcaatgcggaagtttgcgttgttaatttctgtagcaatttgctcacttgcttctttgtcttttgtgcgttcggttggcaaagtaccgtcccaatccgcacgggttacatagttgatatcgcccacagcatattcaaaggcgttggttacttcagccttatcagatgaacgttgtttcaagacttctttgctatcaactgtgtaggtttctgaatccaagacatcatgcgcattgttcatgagtttgatttcatagtcacccttgtccaaaacataggctttttctgtcttttcgtcgtaagatgccatatcatcacggtcgaaggaaatggttaattcttcgctcttacctggctcaaggacctcagtcttatcaaatccagccaagacaacgtgtgatttctcaacaccaccttcagtatatggagctgtgtaatagacttgtgcaacttccttaccagccacgtcaccagtattggttactttaacattgacctcaatcttgtcaccattttctttcatgctagtgatttcttggtcaaagttggtatagctcaaaccgtaaccaaatgggtattgaacaactttatcataagctgcttcgtccacttgaccagtcgcattgtcaacaaagcgagtttcgtagtaacgatagcctagatagataccttcttgatagttaacaaatttgtagttaaaggtttgtggttcttttgctccccatggagttttttcataggtgatattagtataagagaagtcacctgtattccagtaggttggattgctttccaagtcgtaggcataggtatcgaccaagcgaccagatgggttgacctcccctgccaagatattagctacaccagtcaagccggttgagccaggaccaccaatccaaagagcagcatcgacgcctgcatcttctaagaagccgagttccatggcatttgaggagttaaccaagacaacaaccttgtcaaagttctctgtcacagtcttcaacatggctttttcaacttcttgaagttcaaggtagtgcttgtccttgtcaccttgttggtattctgccatgttttgtggaaggtccgcaccttcaccaccattacgagaaatgactaccaaggctgtatctgaaaagttcttcgcgtttgttaacagttcctctgagtatttgtcttgagttggctcgtagatattgtaatctccaccattgagggagaaaatatttgtcccttctttttctggaaggttttctgtgtagaagtctgtcaattcgctgttgacttcaaaacctgcattttcaagaccttgttgcagattgatgtttttggactcatctgccgcacctgaaccagatccaccgtaagtaatggctacagaagaaataccaaagacattgaccttggatgatttttcaagtggtagggtcttattcttgttttcaagcaagacagtgccttcttcttgaatggtcgttaccaaggacttagaaacttcttctgcatcagcaattttagcagcatctgcataagacggcgcaaaataggtgtcgatcacattgacaaacatattgacagcatagttagctccaacgataatgatactcaagagagccaagaggccaaagcccaactttttcttcttgctagagagggatttttccttcactacgcgataaatcgcaaatcccaataagccaaggacaactacagcagaacagataaatactgtttttgcaatcccgaccgcatccaatgattgatagctacttggatagctatctgcatagactatttttcctgatagcagagctcctgctaggctcaagagagcccctttccttttccaagtcttcataagacttcctcctaaacatttcggctttcatgtaagccttttctttttcttgaatccactatatcaattaacatactcaatgaaaaccctttcttcataatctgtcatttaaccttcataatttgtaaatttataagaataatcctactcttgctattttatcatttgattttctaaaatatagctaacaatttcattttaattttgatatactgatagaaaataaaaggggtgctttatgaaaatcgcgattgtagaagatcaaaaaattgagcaagatagattgtccaactacatcaaaacctactgcaaaaaagctgggattgcagtggaaatcagctgttttaacgacggtctccatatcactagtgactatcaaaaacaatttgacctgatttacctagatgtcgagatggagattatggacgggatgaccaccgctcaaaaaattcgaaatcttgataaggaagttctattagtatttgtgaccaatcattcccatgtcgctattcagggctactctgttgaggccattgattttcttctcaaaccactgagctcctttgtctttgaggaacattttaaaaaaattcttagaaaattacccgatagccaagagaagcaaagtttgtatataaaaagcaagcagtccaccgtaaaactctatcaagaagatattgtttacctagaaagtcaaggacatcaggttcacatctacacagttgacagtggcctaaccattacccataatagtctcaaaaatctcgaagccatgttaaacagtaaattgtttgtacgagcccactcggcctatatcatcaatttgtcccatgttcaaaaagtggaaggtagccttgtttacgtcacaaatacagccttgccgattagccgcccaaggaaaaaagaatttatgacagctctaaccaacttcatcggagatagcctactatgatcaatttccctgatattccacgtttctatactgcactaacagaaagcttggcctgcctactggtatgttcctcacttgttttgtctgaaaaatggtcacgcaaacaggtacgtatcctcctgatttttctcatacaaatcttacttcaactagcggctggcaaactccccttgcttctttggactgtaggaatgggcaccaatatcgcttggatgtttgtttccgttcgatttcttggagttatccacaagaggactagtctctatttgacagcaaaagcctttattattgccgaattagtagcctccattacttggcatctctactgtttgacgatttatcaacaacctgtggataacttgtggacacaggggttatttctgttgataacttctctactttcctattggctcatctatcttcaagatcaaaaagttcgcttagaagaattggataaattcattgagcagcgagatgtgacggtagccgtctttacaactttatctatctttgttctcagtaatattggtttcatcctctcaggcacgcgccaatttcaagattcgaccagcatcttcattctccggacaaccgtcaatctctctggtcttctactcctattcacccaagaatctcaacaatacgatcgctatttacggcaggaattgacttctatcaataatatctttcaacttcaatacaagcaataccaagcctatcgtgaaaacagtgagattcttgaccgtaaggtccatgatttaaagcatcaactggccatcattcagcaagaatcggataaaaccaaaaaggagcaatacctagaggaaatgagcgaggtgatccagacacttgatgccaagattgaaacaggaaatcccgttctagataccattctcagccagaaaaattattactgtttgcaaaatggaatcaactttacctgtattgttcagggagaacccctccattttatggatgtaatggatatttcagctctgtttggaaatgccattgacaatgccatcgaggctgtggaaaaaatagacaatcctgaacaacgcttgattactttaaaggttgccagccatcagcaatttctcatcatccgattagacaactacgatacttcttcgcttgacttatccacaggacagctcccagaaacatcaaaaacaaataaggactaccacggattcggtcttaagagtatggagtatgttgccaataaatacggtggcagtctcacacttagcaaggaagataattgggttcaactaaagatcattctccctttacaagtatagaaaaatcccgcttgaaggcgggattttctttctattcatcatttagaaaccgttacttgctccacatctcgactttgactccgttttataatcacatcaagataatcagccaagaaacttctcggtgatgctgcttgcaaggtctgataagcctggcttggaaataccttctcatctagccaagtctgatctagtttttctcctgaaaaataagcacggttggccggcatgataaattgtgaaatagcgtctgccgtctcgccgtcataccaacgctcatcgttcaacacattgtggaccatgatgtcactggtattgtcaaagacagtttgtaagtaggtaacgtgatcctgcaaatttggatcactaggttggtgcttttctgcccacgaagccatatcaagttgagttttttgatagtgaatgcttgtatcatcaaggctcaattgaccgataatagctggataaatagaaaatgctccattgaccacttcagtatagttaacttgtcccaagtcttccttaacaatattctgagaatgagtatggcctgaaaaaccaaaatgaatcccatactgatcaaacaaagccttcaaatcggcagcattatccaaagtatagccttttgagagcatggcatgctgttgcaagacattgtgatggacaacaggtaacaggctcactccagcttccttggctgcctgaagctgaacttctatccattctagggtctcttttttgatacatccattggttggaggagctccttttccgtagccgtcagagtagatgttgctgtctatcatcagaaaccaagcattggaaaatggtttggccaggtagctcaatgaggctttgtcacgactgctagcttgttgataaccgtgattgacaaatagctctgcaaattgctgagcagtgacctgatccgtcactatctgctggtctcccttaaaggctctagcccatccactggcaatatcatggttgccaggaatcaccaaaacctccgttcctttttcttcaatccgggtaaaatattgcgccaactcaaccatgctctgtttttcaccgtttagagtcaaatccccactgactagtaataaggacggttgctcacgctcaacctgctcaaccaaagcctccatccgctcttttccataacgtaaatccttaccagcagctgttttttctatataggaaaaagcctctccatcatcaaataaatcctgtgacaaataatgcaaatcagtgataatccagattttatcctggtctcttaactcagcctcggcataggattgctgacgctggccagtaatagccgaccaagtcaaaactataactgcaatagctcctaataataatactattttcttcttcataccttaaaagtatatcatcttagagatagagggacaagaaaaagaagctcgaccttctttctgccgagcctcttatgtctacaatttatttcttagcaaatccagctgcttgttcaccagcctgacgaccaaatacgatgatgtctgctgctgcattaccaccaatacggttttgaccatgaacaccaccagttacttcaccagcagcataaagaccagaaattgctgaaccgtctgttttcaatacttcagtattggtattgattttcacaccacccattgtatggtgaacaccaggtgcaactttaatggcatggtaagaaccagtattcaaagcatggtccatacctgatgtacgaccaaatgccgcatcatttttgtctgccacagccttgttccaagtatcaagtgttgtttgaagagcatccgcaggtacaccaatttctttagccaaatctgcaagagtagcacccgtttttacaagacctttttcttcatattgagcaatagccttcacacgatctttcaaggcatcatcaaagataacataagcatagtttggatccaaactattgatagccgcagaaactttatcacgagtttccaattcgttaacaaaacgctcaccttttgagttgacaaggatagcaccttcgccacgaactgcttctgtaatcaagtaagaagtttcttgctcaacacttgggtgaatttggatttgttccatatcaacagttgctgcaccttctgattcagcaagcgcaataccgtcacctgttgatccttcttggttagttgtaacataacctttcaatgctgggtttaatttagcaaccatttccaaatcagcaccgaaaccaccagtcgccaatacaactgctttagctgagattttcttagtttcaccagcaatcttcacttcaacacctgtcacagctccatccttgtcttggagttttgtaacatctgcattgacaaaaattggtacttcacgttcaacaagattgtggtaaagaccatttaccaagtagccaccgacagctgaaccatctgctggacggtgggtacgtttctcgctcataccaccagttgtagttaggttgctaagagtgatccccattccatccaaccagtcaattgcactagcagagttatctacaagataacgaagcaattcaggatcgtttgtccctttaccacctttaagcgtttcttcgtagaatttatcatttgtatcagcaataccttccgcttcttggaatttagtctgtgaagcattcataccagctgatgatttagccgtattaccaccgataacaggcattttctccaagagagcaacactagcaccagcgtctttagctgagatagctgctgacatacctgcaccacctgaaccaacaacgataacatcgtagctatctttcaactcagatggatctgtataaactttctcagatgcacctgaaacagcttcttctgatgaagaagaagtcgtagatgatgaagatgtagctgtcttttcagacttacctccacacgccactaaaaacaaaacagcaagtagactcattaataagcctaaccaagctttctttttcatataaacctccaatttttatctggtattagtattatacaagattgtgaaatgtttttcaatttgttttgaaatattttcacaaacatgaacaaaaaaatgtatgatatccgcttcatacattcttaaaactatttactgcccttgaagagctaaaaaattctctatttcggatagcgttgcttggctccctttacggagtattccagataatttacctgatttatagtaggttaagctaggaaccgtagcaagaccttgactctgtcgaaattgttgtatttttccattcggatccgactcgctatctaaatagtagatcgtcgcatgtgattgctctactgcctctgttaatttcggaacaaaatcacgacaataagggcatgtctcacgacctatgtataatataaattcttcctcgtcttggaccttttgctccacttcgtctatcgaaatagcctggtaactctttacagccttcacatagtctgattcatttggcgtagccgctgattgagatagaaagaaggccccacctacgaccaaaatagctaatagcactagcaaaaaatacttacgccacataatccctcctcaaatacagacaaaaagcccttgtaaatagggcttttaaaatatcgatacaaatcttagagcattttgttgtagaattctacgacaagagcttcgttgatttctgggttgatttcgtcgcgttctggcaagcgagtcaatgaaccttcaagcttttcagcatcgaatgatacgaaagctggacgtccaagagttgcttcaacagcttcaaggatagctggaactttgattgacttctcacgaactgagatcacttgaccaacttcaacacggtatgaagggatgtcaacgcgtttgccgtcaacaaggatatgaccgtggtttacgaattgacgtgcttgacgacgagtagttgccaaaccaagacggtaaacaacgttgtccaaacgacgctccaaaagaagcatgaagttgaaaccaagagtaccttgtttgattttagtagcttgtacgaacaagttacggaattgtttttcacccaaaccgtaagagaaacgcaatttttgtttctcagccaattgcaaaccgtattctgacaatttagaacggttgtttggtccgtgttgacctggtacgtagttacgacgtgccaattctttacctgtacctgtcaatgacaagccaagacgacgagcttgtttccaagatggtcctgtataacgtgacataagttatgtcctcctaaaataaaaatttccgtcatttcgtttctcttttattacgtcgttaagtcggcttggcatacctcagtatagcctgcacctccttgcctagtactaaaaggaaacaaaaagacttatctgtaggaaataacgttttaagcaaacctgattcgtgcaggaggccttcatcgaaacagcaacgattactcttcttgctgaccttctgttgacgagcttcattttgccctgctgttatttcacacaaagattagtatagcacaaaaaaaaggctctgtaaagccttatatagcgattaatccaaataatgaatcaaaatcttttcagtcaaaatgtctgagtaagtataagattccacaaaggtattgtttggatcttcaaattcaacgatgaagagagactgataaacctctacaatacgcccctgcttattcttctcacgcttacgaccattttcaagggtcaactcgacaatctgtccctcatggtccttaatatcttgtttgatttgcttcatcttagcaacatctgtaaatgcatcactcattctctatccatcctccctcttggaaatacttgcaaatttattgtattctttttggaacatgagttccacggtaccacgcgcaccggaacggtttttctcgatgataacttcaaccgtattattgggaataccaccgtcttcttgctctcctcgttcataataatcatcacgatacaagaaggcaacgatatccgcatcctgctcaatagaccctgactcacggatatcagacaagacaggacgtttatcttgacgttgctccacaccacgagacaactggcttagagcaataactggaacttttaattccttggctagaattttcaattgtcgagaaatctctgaaacttcttgttgacggttttctcgaccggttcctgtaatcaattggagatagtcaatcaaaatcaaacctaaattccctgtctcctgcgccaatttacgagaacgcgagcgaatttcggtaatcttgatacctggagtatcatcaatatagatacttgctcgagccaaattagcttgagccaccatatacttgttccattcctcttgcgttaggtgacccgtacggatagccctcgaattgataactccctcagaagcgagcatacggtcaaccaagctttctgcacccatctccaaagagaagatagcaactgtcaaacccagttttgtaccgatattttgagcaatattgagggcaaaagccgtcttaccaaccgcaggacgagccgcaagaataatcaactcttcctcatgcagacccgttgtcatggcatcaagagcaggatagccagttgcaatccctgtaatatccgacgtctgcttagcacgagtttcaaggttgtcaaagttgatattcaagacatcatcaatccgcttgaaaccacttcgactggctccctcactgacatcaatcaaagctttttcagcattggcaataatgtcatctgaaccatccgtaccctcataagcctgattaactgcatccgtcaaacgggcaatcagtttacggagattagacttttcagcaacaatcttggcatagaattccgcattggctgccgtcggtacggaactaatgatttcagccaaataggccaaaccaccgatattttccaaatcaccatggttcactaaatagttacgcatggtagtcgcatcaattgcctcatttctatcagaaagagcaatcatagctttaaaaattagcttatgagcatgtttgaaaaaatcttcagcttcgatgtattcacgaacgaagaccagcttgccttcatcaaggaaaatagctcctaataccgattgttcagctagaatatcctgcggttgcacccgcaattcatccaactctgccaagatctcacctcctcactggctagataaataattaagcttccttaatactcaaattaatgatgcctgttacatcttgatagattttaactggtacatcaatgagaccaatcgcacgaattgggtgatccagctgaatatggcgtttatcaatcttgatgccaaattgcttgtccaattcttcagcaattttcttgctggtaatagaaccaaaggtacgaccatctggaccaactttttcgacaaatttcactaaagtagcttcctcagccaacttagccttgatagcctctgcttctgcaatcatctctgcatgagccttttccttagatttttcctgaccacgaagggcgctgattgcttggtttgttgcttccttagccaaatttttcttgatcaagaaattttgggcgtaacctgttggaacttccttaatctcaccctttttaccttgacctttaacatctgctaaaaagattactttcatatctgttctcctaatttccatttatttcttcgcggattttatccgtcaacttttcacatacttctgcgattgtctggtcatatacctgagcggcagctaggttaaagtggccacctccacccatttcttccatgatgcgttgaacattgattttattatgactccttgcagaaatagatacataccctttgatatttcttgttacaacgaataccgcctcaattcctgccatgtccaatattgtattggcagccttactcggaataatattatcgtattctttagtatcatctgcacacgcaataacaacattggactcaattctctgcccacttaaaatcagttcattgatttgacgatattcctcaaaatctgtcgcagcaatctgctggatttccaagctatcgctaccacgagtccgcaagtaactagccacatcaaaagtacgactagtcacacgagaggtgaaattttttgtatcaagcataatcccagccatcaataaactagattgaatgcgattaagcttatggtgtttgtcattctggaactgaattaattccgttactaactcactcgcagaactagcaccactctctatataagtcaaaactgcattatttgggaaatctgtatcgcgacgatgatgatcaaccaccacaacctgggtaaatttttcatagaaatccttatccaaagtcaagccaatctttgaatgatctaccatgattaacaacgactggaaagtgaccatcttcatggcttcctcaaccgttaacaaattagaacaattttcatcactcaacttcttgatagcacgtgcaatatctggtgccatttcatctggattatacaccgtataagcattgttcataatattttgagcaaagtactgcatgccgaccgcggatccaagcgcgtccatatctaaattacgatgtcccaccacaaaaacagcatcaaccgatttgagtttatctgatacagcagtcatcatagcacgagtccgcgtacgtgttcgtttaacggaagaagccgagccaccgccaaagaaaagtggctgtttactctcatcattttccttgaccacaacctggtctccaccacgaacctcagccatattgagattttggagcgcaacctgtccgatttggtgatgattttcattaccatacgccaatcccatactcaaagtcaaacctaaatctaactttttagcctcctcgcggaacttatcaataactgaaaacttattctctatcaatttttccaacacagcataatctgtaaagaaatagaatcgatccattgtgccgcgtcggtagtagataccgtaatcatggcaaaattctgaaacaaattgagccaagaaggaattgacttggctaatttgagaatcagttacagcatcctcaagctcatcatagttatcaactgaaataatccctataacaggacggcttccgatcaaactatttgtcgctgaatactctgtcgacgcatcaaaaaagtaaaataacccttgatcaaaatcaacgttaacagcgtatctcttgcctgaaaagtttgcataaattcgctcctcatccagaccaacgtcaataatttcacgtagttttttttgatcaaactcaccattttcttgagcaaaaatcagctcagcaaagggattaaaccattctacctgattactatctggtcgaactttgataactcccactggcattttatccaagagcatcatcaaaccagaattggcctgattattgagatattcaatctgttctagctcactaaattcataagaatgtttttgataaataaacagcgcaatcaacaccaataggctgatgagtagcgcaaaaactgtactggcaccaattggaaaaaatcggtggacaagagccaccaacccaaataaaatgacacatatcatgacaaagtgaattgtcgaaaatcgaaatcttttcatcactaacctctgcctgccattctaccataaattcagtaaaaaagctacttttcacatgattttaaagtagttgacatatagctgacatacagcgaaaagaacagccttagtgactgtcctttgatttatttttagaaatggaacgactgcgtccttccaagtagaccatgagaatggatatatccgctggattgacaccggaaatccgactagcctggccaatggtttctggtgaaatcagcttgaatttttggcgagcctcggtcgcaatggagtcaatatcatcccagtcaatgtcggctggaatgcgtttttcttccatacgtttcatcttctccacctgatctaaggccttagcaatgtagccctcgtacttgacttctgtttcaatcaattcaatggtcttggcgtccaaatcctctgccgcaggaccgataaaggctaccgcatctgcgtaagtcacatctggacgacgcatgaattccttggcagtcagagcgtctgtcaagggcttgaagcccatggctacgactttttcgttggtttccttgattggcttgagtttgatagactccaaacgcttcatttcattgtcaaattggtttttgtgaatctggaagacctgccagcgttcatcatctaccaagccaacctgacgaccaatctccgtcagtcgcatatcagcattgtcatgacgcagaatcaagcggtattctgcccgactggtcaagaggcggtaaggctccaccgttcccttggttaccaggtcatcaatcataacaccaatgtagccgtcgcttcgtttcaaaatcagctcaggcttgccctgcaccttgagggctgcattgataccagcgacaattccctgacctgctgcttcttcataacctgatgttccgttggtctgacctgctgtaaagagccctgaaatcttcttggtttcaagcgtcgcccgcaactggtgcggcataaccatatcgtactcgatagcatagcccgtccgcatcatctgggcattttccaagcctttaatagagtggatcaagtcctgctgcacatcttctggcagactggttgacagcccttgaacatagatttcgtctgtattgcgaccttctggctctaggaaaagctggtggcgttccttatccgcaaaacggacaatcttgtcctcgattgacggacaataacggggcccaatccccttgacaattcctgaaaacataggtgctcgatgaagattgctgttgataatctcgtggctggtggcgttggtataggtcaaccagcaaggaatttgatccagcaaatagtcctcgtccttggacaagaatgaaaagtggtttggcttttcatcgcctggttgaatctccgtgtcttcgtagttaatggtacgagcattgacacgcggtggcgttcctgtcttgaaccgacctatctcaagtccaagttctttcaggttatccgccaacgtgatagaggcaaggctattgttaggccctgacgaatacttgaggtcaccgatgataatctcaccacgcaaggctgtacccgttgtcaccacaactgccttggctgagaatttctggttggtagccgtgcggacaccgataaccttgccatcctccaccaaaatctcatcaatcatggtttgacgcagggtcagattttcctgacgctccaccgtccgcttcatctctgatgcatactctgccttatctgcctgagcccgcaaggcacgaacagctggccccttgcccatattgagcattttcatctgaatgtaggtcttgtcaatgttgcggcccatttcgccacccagggcatcgatttctcttaccacaatccccttggcagagccaccaatggagggattacaaggcataaaggccaccatatccaagttaatggtcgcaagcagggtcttacagcccatccgactggctgccaatcccgcttctacacccgcatgccccgcaccaatcacgatgacatcatagttttctgcaaatgtgtgtgtcatgttgttctctccttcatgttcatgatatgtttaacttgtccactccagtttggtaattcctgtgtcagaaaagctggtacgacatctaagttgacaaggttgtcaagtgcaatccattcacacggttgtttcaacttcccttcaatcatctccttaggcatttctccaataggctcaacgataaaatgaaactcgatattgtgaaaatctataccttcatgtgtaaactgattttcaacgacaaaaactaattgattgacacgactgtcaatccctaattcttctttgacttcccgaacagccgcatccgctgctacctcattgacctcaaccgcaccaccaatcgtataataacggcccttagcgtccttcgtgagaaatattttcccatcttttataatcaatgcagtggcacggacaccgaagatttgattgtcaattctggtcctaaaatccatttatccttctcttttctaaaatttcgtccagatatggaactaagtttttcttatttttatcgctaggggctaaccatagaaaatctgtatgctcttctgggtcaagaagaatggttttcggttgttcaggaagtgttacttcataaaccagccttgtaaacaccgtctgtttttcttcatcaaactgactatcttcatggataatggtcagattttccttttctatcgaaatacctgtttcctcaaaacactctctcactgcagcatcacggggcaactcattctcctcgacacgaccgcctggaatatcccaatgcagcggaaatacattcggctctccacgcttaatctgcgaacgctgaatcatcaagtgactgtctgcaacagtcagcaagacatgggcaatcaatttaacaggcatggtttcctccgctactttagttgtctttgttcataaaatgctttagttgtccgtcccatttggctagctcggtcttaagaaaggctggattgagatccaatttctctaagtccacaaaagcaatccattcacactggcgaatggaatttccttcttccagataggtgactggctcggacagtggggtaacaagataaagaaattcaatctgatgataggatttctcctgcaaggtgaactgattttcaacgatgaaagctagtggtccaacctccacatcaattccgatttcttctttcatttcccgttgcacagcctcttcggttgtttcaccaagctgaatagctccacccaaagtgtagtatttcccttcaggcgacttaacgagatataacttctcatcttgtaccaccaagcccgtcgcacggacaccgaaaatttggttgtcaactctggttctgaaatccatcttctctccccaatcgcaaaaaatagccaaaactctcgaaaactgcaggacaaaaaagcctacaattcccatgagctttgaccatcatgataattgttacgcttattttagcaaaagatttgtagaatttcaaatctggtgttacgttaacgtttcaatatattctaagccccaagcctcaacagcatccagcaccgaacgaaatttttcgcccatttcagtcaagctatactctacacgaggggggacttctgcatagaccgtgcgactaataatgcgatcctcctccaattgtctaaggtgccttgttaacatggtttgagtaatacctggaattagtcgctgtaattcattgaagcgtttcgttcctgtactgagttggtagataatcaccaatccccacttaccagtcaagactttttgcgttgttgcaaaaggacaaataccatattcactaactttgttcaaaaaaattctcctttatttatcacaatagtatcacttttgataccaacaaatacaaaagtacctacttgtataattgactacttccactataattgtactatatcaaaaaaattggaggacatcaaatgtcaacaaacttagaaatttttaatgcctataacaatgctctcatcgctggtgattttgcagctctttttgaaacaatggcagacgacattatctggcatcaacccggaaatcattcaacatctggtgctaaaattggtaaggaagtactcggagcacatctagcaactttcgccgaaaaaacaaatggaactttcaaagtagtgacaaactgggtatccgataatgatactcttgttgccgctaacgtaacattcctcggtactcgcacagacggtgaagaactaaacatgaatggtatcgatcttttccgtatggaagatggcaaaatcaaggaagtttggctcttctcagccgaccaaaaagccgaagatgctttctggggataagataaatagcttagcacgagagtgctaagctattatttttgattaaatatactgacaagcctctccgtctttataggccatgtcaatcatgccgccaccgaggcattcctgtccgtcatagaaaacaacggcttgtcctggtgtgatagcccgttgtggctctgcaaagatgacttctgccttgtcaccttttaccttgacagtcacttgactgtctggttgacggtagcggaacttagctgtacactcaagtgtgaattcttcaggcatatcacgtgtaaagtgaacttgactagcctgtaaagaagttgacatcaaggactcatgatagaagccttgaccgacatagaggatattttttgacaggtcttttccgacaacaaaccaaggctcattgtcccctccgatttgtcctccgataccaagcccgccccgctgaccgattgtatagtacatgaggcctgtatgctctcccatgtcacgaccgtcaacggtcatcatccgaccgggctgggctggcaaatactgccctaaaaattctttgaagttcttttcaccgataaagcagatgcctgtcgagtctttctttttagcggtcgccaagcctgctcgctctgctatttccctcacctgaggcttttgtaaatggccgagcggaaacatggttttctgcagctgttcctgtgagagttggctaaggaaataggtctggtccttaccattatctgccccacgcagcatatgaacggtgccgtcctcgtcgcgggtaacctgagcgtagtgccctgtcgccacatagtccgcacccaagttcatagcgtaatccaagaaagccttgaacttgatttccttgttacacatgacatctggattgggcgtgcgaccagcccgatactctgctaaaaagtactcaaatacgcggtcccagtactctttttcaaagttgacagagtagtaaggaatgccgatttgatctgccactgcagccacatccttgtaatcttctgttgctgtacagaagccattttcatccgtgtcgtcccagtttttcatgaagatgccgatcacatcgtagccctgctctttgagcaagagagccgtaaccgatgaatccacaccgccactcataccgacaacaacacgggttttagaattgtcaattgacataatcttctcccatcttttcgtagaaataacgatttgaaggtcgtattccaaaatttgattatccaaaaacgattgacgattttgaacaacttgtattataccatacaaaaagggtaagcgatagaattttaacataagaaaacacattcatctaggcatattctctaactggaaaatttgatataatagtaccaagaaaaacgtgaggattactatgacaaacttaaaatttcagtcggtctttgatattattggacctgttatgattggtccatcttctagtcacacagctggggcggtccgaattgggaaaattgtgtcttccatcttcggcgatgagccgacagaggtggaatttcaactctataattcctttgccaagacctatcgtggtcacggtacggatgtagccttggtagcaggtattctgggcatggatacggatgatccccgcattcctgactctcttgatattgcaagagaacgaggcattaaggtttactggcgtgtcaacaaggacagcaataccccacatcccaataccaccagaatcatcataaaaaacgataaaaaatccatctcagccacaggcgtttccatcggtgggggaaacattcaagtaacagagctcaacggcttctctgtcaatctaaatatgaatacgccaactattattattgttcaccaagatgtccctggtatgattgcgaaagtgaccgatgttctttctaagtatgacatcaatatcgcccaaatgaacgtgacacgtgaaaaagctggcgaaaaagccattatgattatcgaagtggatgctcgccaatgtgaaaattctattgcagaaattgaaaaaattccacacctgcacaatgtaaccttcttcaactagaaagagaaagacatgttttatactatcgaagaattagttcagcaagcagacaacttttctggtaatgtagctgaactcatgatcgcgactgaaattgagttgaccggtcgtagccgcgaagaaatattgacaattatgtcaagaaacttgacagttatgaaagcctccatcgtagatggacttactgaaagcaaatccgtatctggtttaacaggaggcgatgctgccaagttagatgcctatatgaaatctggtaaaaccttgtcagattccgctgtcctatccgccgcaagaaatgccatggccgttaatgaattgaatgccaaaatgggcttagtctgtgccactccgacagcaggatctgcaggctgcctaccagctgtgctaggagttgctattgaaaagctcaatttgacagaagaacagcaacttgacttcctatttacagctggagcctttggactagttatcgccaacaacgcctccatctcaggtgcagaaggaggctgtcaggcagaagtcggatctgcctctgctatgtctgccgcagccctgacactggcagcaggtggaactccctaccaagccagccaagccatctgctttgtcataaaaaatatgctgggtctgatttgcgatcccgtcgctggtctggtagaagtcccttgtgtcagacgtaatgcaatgggagcaagctacgccatggtagctgccgatatggcactggcaggaattgaatcaaaaatccctgttgatgaagtcatcaacgctatgtaccaagtgggatctgccctaccaaccgccttccgtgaaactgccgaaggaggccttgcagctacaccgacgggtcgtcgccttgctcaagaaatttttggagaagattgacaataatgtaaaccaaaaaggaccctaacggtcctttttcttattatggcttcgggctagttttctcatagagaaaaacaagaaaactactacctatgctggtggctagcaaggctttgagcttctatttttttcctgttataatctaatttgtcaagttaaataaaggaggagtaaactagtccagtggactagtttagcatggttaaaaccgttacagtttatcacataccaaatgtatgtcactcctaagtaccgcagaaaatccatttactaaaaaattagacgggacttaattgatattttccatcacctatgtccatacagcgtggaaatcaaaagttttgggctagaggctactattcagtaccgttggactgaacgaaaaagcagttgtgaaatacattcgtgagacagaaaaagtctagcatcgtgctagacctcttctaatttatcttagtaccaaccatttgccaaccagaaagccttggctgcagaccatgaaccatagcgactagcaacataagcatctgctacacgctcttggttttctggtgagtaatcaccattcaagtaagtatttgtcaactggtaacgaccaatgtagataccgttacgggcatcatagctaccgcttgattccttcattgcaatccattcttttgctgctgcatcttcagcactcaaatttgaagaataggtgctagtcgttactgttgcggtagaagttgatgttgattgagtttgttcaactgaactctctactgccttcactgtcacatcacccaattcgataacttgaccgacatggataaaatctaagttggtaatcttattctgctctgctaatttttcaacagtagtattgtatgtttcagcaatttcagacagggtatcaccagactttacagtataggtttctgcactgactacacccgcagttaaaagggagattcccgctaccaaaccagcaatagttgtttttaagtttttctttaatgtaatgttcataatagtcacattcctttctgtcatgtgtctatcataccctctaactattacttagactttgtgaaattgttacaaatattacagacaaattgagattagacaataaaaacgctatttctagcgttttttacttattttttcaatataaataagagtccggctaaagctaacataactaaaattgctaacgtatctgctaacttccattccaaaatccggtacttggttctcccatcgccgccttgatacccacgcgcctccatcgccgttgcaagagcatctgccctcttaaaacttgatgcgaataacggaatcaaaataggaataactgactttaccttctgaataagatttccctcattaaagtccactccacgagctctctgagcattcataatccgagtggtatcatccatcaaggtcggtacaaaacgcaagctcatggacaacatcaaaccaatttcatgcacaggaactttaaatttcttcaaaggtgcaagccccgactcaataccatcagccaagctaaggggtgtcgtcgtcaaggtcaatagggttgagaagaaaataatcaaaacaaagcgaacaaaaataatcgccgcctgttgcaacccttctacagataatttaaaaatccaaaactcccatagaatggtcgctccaggtgtaaagaaaacctgaaagaaagttgtaaatagaataattcctatcatcggtttcaaaccattaataaaaaatgataagcgaatacgtgataaaacaaccattcctaaaacaaatgctatcaacaaggcattggtgaccaaattattggcccaaaaaatcatcaatagaaatccaaacattgctaaaagcttacttcttggatccaagcgatgaataattgaatccccaggaatatagcgacctaaaattaatttatccatgtgtcaccatccccgtaaattcttcaattgtaataggaagacgttcaaatacaaagcctcttctctccaaattagctgcaaacttagtaatcttaggcactcccaactgaatactctctaaaaaatctacctcttgaaaaatatcgactggtttaccagaacggaccagctttcccttttccataatgtaaacaaaatcagcatagttagccacatcgtccatcaaatgagttaccaaaacgattgtcatgcctgattcatgaagctttttgaaaatatccatcaattcctgacgacccgcaggatccaatccagccgttggttcatccaaaactaagatacttggttccattgccagaatcccagcaatagctacccgacgcatttgaccaccagatagttcaaaaggactacgctcaaacaagctttcatcaattccaaccaaggccaacttttcacgcgcaatcgtttcagcctcttcctgagaaactccgaaattttgtggaccaaaagcaacgtcttttaagaccgtttcatcaaacacttgactttcaggaaattggaacaccaaccccactttcttcctgacttgcttaatatccttattttcagacgtcgctgtaatcacaacatcatcaataactactcttccttctgttggtacatttaatccattcaagagttgtaaaatcgttgatttgcccgaacccgtatgcccaataagggccgtgtaagagccatcaacaatctccaaatccacaccaaaaagcgcacgcccctcaaaaggagtgccagcttgataggtatagcttacttcttggagatcaattcccataaagtttcctctaattcttcctctgtaaaatagcggagcggtaaatcaagtccagtctggcgcaaagatgaagccagttctgtcgtaaacggtctatccaagtctaaatctaccaaatcttctcgcataaatagttcatttggagtgctaattgattcaacctgtccatttttcatcacgataactcgatcactcaatgcaacctcatccaaatcatgtgttatagagataaccgtcataccatgacgctccttaatttcacggacaatcttaatcaagtcgagacgaccttctggatccaacatagacgtagcctcatccaaaataataatttttggacgcaaggcaaccactccagcaatcgccaccctctgcttctgaccaccagataaacgagcaggctcacgtgttttgaaatcagtcattccaactaattccaaagcttcgtcaactcgactacgcatctcctccaaagggattccctgattctctaaaccaaatgcaacatcatcttcaactgtagcgcctacaaattggttatctggattttgaaaaaccataccaatcaagcgtcgcttatcccatacattatcaatggttaaggcatcaccgtcaatataaatatcacctgattcagcttccaacaaaccatcaatcaaacgaactgttgttgatttacccgaaccattatgaccaataatagatagccactctccctgtttcacgtgaaacgaaacatcatttagagtatattgctcatcctcttggttgtatttatattttaaattttttacttcaataatattcatcatttaaatgtatctttaaacaagaaggacgcacccttgaaataatcatagccagaatatagggtgaagaaaagtgcaatatagagtgttatttgccccacgacgttccagtgtaagagcaggaaaataactgcaaacatctgtgaaaatgttttgatttttcctggcatagccgcagctagaactgttcctccattttccaccaagagtagacgaagacctgtcactgccaattcacgacaaataataattgcaactacccaagctggagcaaagccaagctctacaagcatgataaatgctgtcatcaccaaaatcttatctgccatcggatccgcaaattttccaaagtttgttacaacctgccatttacgagccaagtagccgtctagataatccgtaatactagctaatgcaaaaataagtgctgctaagacatgactaattgttgaattccaaacggtcagtaacaagataaaaattggaattaccaaaatcctacctatcgtcaatgcattgggaatattttcttttttcatataaaacctttattgttcaaaatttattgtaattgagcctgtatctgctgtcagagctgatagttctagcttttgaccacctacacttacctcaacccctttaacaacaccaagaataagtgtagtagaagtcactccttcttcaatagtagtagttactgttggattatcaggtgttagtgtaacgcccccctctaacaaggtgtcagaaaggctgatccaactcgttgtattttttgctgttacagttacttctactggataagtcactgttttaagggtcgcaacaatgttagaacctgatcctgaaatagtcacattttctgtagcggaactacttgaactcgttgaatttgactgcgcctgctcagtagaactcgtctctgtgccactacttgcttcagatacagattgctcaactatactatatgacgttgtagtaggcgtaatagatgctctatttttgagcctgctatgaacaatataaatcacaaaaataataatcaaccccgtcgcaagtaataagtaaatcaacggaagataagagttctttttacgtttacgaaccttatagcttcttttcaattctgaagagcgtagttcttcttctccatcttcataatatttcactaaactattggtctcgtaagcatccagtagaacatctgcatctaattccaaagcctcagcgtatgcttttaaaatagactgaacaacatctgagtttgcaataaaatcaaaatcattgtactcaagtgcctgcaaatatttagcttggatttttgttatccgttgcaagtcaacaaatgtccaaccccgtccttctctggctgttctaagtacttcccctatactcttttgtctcataataccctctctctatcgctcatcatgtacagtatactattctaacaaaattccaaggaaatttcgacgggttgcgcccacttattttggaaaaatcgtgaaatctgtcatatcacagtgatcaataaagcgacgacctgcctctctgatgtcatctaactgaagactttgtatcatttgaggtatatcaaaaacattttcatattctgaatactgagaaacaaagtgactagctgtaaactcaagagaatttaagctacgaataaaatctccatacatctcgtttttcaacaattgtaaatgatcctctgtcacatctgcatcatcctcaaatttcctaagtgctttcatcagtatactagaaagcgtaatgggttcttgagtatctcccgagataatcaaatagtggtattcaggtgtaacctctaattggaactggaaagaagaatcaatttttccctgctcgtataactgttgatagcgttttgaagtccaaccaaacaacatggcaaataaaaattgtaaactaagccgatatttctgaatagtctccttatcaacctcgtcatttccccgtaaaccaacagccaattttggggtagatacttcaaattgttctgagagatgttcctgtatcggcaacttttggatacctgccaattcaaacgactgagctggattatccatctgagctacttgataacttgaaatttgtttccaaactgcctctaaatcaaaattaccaataacgaataaattcatgttacttggatgataaaacacatcaaaattctcatgtaaatcatccgcagtaattgcagcaattgattcaactgtccctgctatatcataggccaaaggactttctggataaagcgatgatagaattcccgtaaacaagcgataatctgcatcatcttgatacatctcgatttcttgttcaataatcccctgttctctttctacattgtcttctgtaaaatacggttctcgaacaaaagattgtaaaagtgatagagactccaatactttctgagtcgttgaaaataagtaactagtctgtctaaaactggtataagcatttgcgcttgctcccaatttagcaaactcattcataatatcctcttcattctcagtttcaaacagcttatgttctaaaaaatgtgcaatccctgcaggataaacaacactattaccattagccaatgtaaatcgagtatgaatacccccaaaatttgtcgttagaattccatatgtctcatggaaatctactttaggaagcaaaataactgtcaacccattgtcaactttcccataaaagacagattctttcatgtaaggatacttcttctcaactaacttcattcttctgtcccctccataaagtaaacagcctgtaaattaatcatctgtcctacttgaatgacatcgtctattgataccgatttgatagcctcaatccaatctaaccaacttaaatttctatttcctaaggtaacttgattatatacttgttctatcaaattattctgcctatcttgagccaaggttgctgaatgaatcaacatgttttttgtcaactctaattcttcttctgtaaacttaccacattttaaatcaagtagttgtttactaattaacttcattaccctgagtctattttcacggctaattccagcatagacctttagcattcctgaaaaaatagagacctgactaccaattgtataggccaaactttctttctcacgaacattcataaataacttcgaatgggagaaagcacccagtagaccattaaataccatcaaagccggatagtttacatcgttgtaaaccacctgtaaatgatatgccaattccaaaatggactgccttgcctgtttacgctcgattttttcttgcgtgatatttgagtattcctgatgatattctaactctaattttggatttctataagtaaaaccaaaatcttcaagttttctttttacttgttctctgtcaaccttccctaagacaaatatatcaattttatccatacgcaacatattccgataaatctgaaaggttgattctgctgtttctttttcaaccaaatcaagcctaccgacgcgtggaatttgaagagagggatctttataaaaaagcttactcatttcaacatctacatgataaaaattatcttctatctctgactgaagaaaattgattaaattcgttttttcaacctcgaaaatctggctatcaaatcctcgcccctttttcagtggtctaaatatacatgtgtataaaaaatcaagaatctccactgtaatatcctcattttctggtaagtgacgaggactgacatatgaaattgtcacatctacacagtgcaccctaccacgtttcgaaactgaggtcgagaactgagcaccatacaattctgccaatcttctccgaacagcctgagcagtctgaaattcttggttacccatttcaaaaatatttgcaactaacacacgaccagcaactgtagcctcactcatttcagctgcaaagcgaatacgtatacgatttgtcgtaaactgatctgtatcaataaaatgaagatctactccctcttgtaatttcatcgtcttcctctttcaaacattgtaccttccattataccattttgtgatataatattctgtaacgaggtgacttatggaatttaaattatttgatgactacatcacattacaagcattgttaaaaacgactggtattctccattcaggaggtgccattaaaggtttcttagaagaaaataccattcttttcaatggagaggatgaaaaaagacgcggtaaaaaaatccgtgtcggagatgttatcacactcccagaccacaacaccagcatcacaatcgtcgctcctagtgcagaggaaatcaaacagcaccaagaggatcaagctgaaaaagaacgtgtggctgcaatcgttaaaaagttaaatcaagaaaataaaaataataagaaacaggtaaaaactcctaaaaaagcaactaaaaagactgaaagaaaacctgttcgtttccctggtatgtagacatgtggctagaacgattagagttacaacattttcgcaattacaaccaattagatattgagttccacaaagggctcaatgtctttttaggcgaaaacgcccaaggaaaaaccaatattctagaatctatctatgttttagccttaacacgaagtcatcgaacacggacagataaggacctactacagtttcaagaaaaggaattatctatttctggtttactccatcgcacaagcggtaaagttccccttgacattcacttgacagacaagggacgagtgaccaaggtcaaccatctcaaacaagccaagctttccaactatatcggccacatgaatgttgttctcttcgcccctgaagatttacagctgataaaaggtgcgcctgctttgagaagaaagttcatcgatgtcgagctcgggcaaatcaagccactctatctctctgacctatcgaattataaccacgttttaaaacaaagaaatacttacctcaaatctacagataagattgatgagaacttcctatctgtgttagatcagcaacttgctgaatatggtagtcgtgttatccaacatcgtattgactttctaaagaaattagaggaattcggaaatagaaaagttcaagaaatatctggcaatcgggaagaattgacaatcgaataccagacctcaatcgaattgacagatgatgtcaatttaattgacaaattcttgacggaactagaaaagtctcgtaaacgtgatttatttaagaaaaatacaggagttggaccacatcgagatgatgtagctttctttataaatggaatgaatgcccattatgctagccaaggtcagcaccgcagtctcgttctgtcactcaaactagctgaaattgagctgatgaaagaagtcacacgagagtacccaattctactcttagatgatgttatgagtgagctggataataatcgtcaaatcaaactattagaaactattacagatacgattcaaacatttattacaacgacatctttagaccatttacataagctacctgatagtttaaaaatcttccatattgagtctggtaaggttactgagtcagaataagattgtttacactatcgtcaataaagtttacaaaaaagtaaagaccctgtcaagagggtcttgcagaacgtagacaaactcctaaaaatataaaaaattgaagaagtttgcgaaagatagcaagttattaaactcttagaaatattgatatttcggcgtttctgagagtttttttattttcaatataaagaaaaaaagattgaagaaaattgtccaaaatggactttttcttcaatctgaaagaccctgccaagagggtcttgtttttgttttactgaactgaatagtttggagcttcgtttgtgatttgaacatcgtgtggatggctttctttcaaaccagcacctgacatttcgatgaattgtgcattttcatgcaattcagtcaagttaccagcacctacatagcccatacctgagcgaagtccaccaaccatttggaaaatcatatctgcaacagaacctttataggctacacgtccttcaattccttctggaacaagtttgttggcttcattgacagatgcttggaagtaacggtcttttgaaccttgtttcatggcagcgatagagcccataccacgataggtcttgaacttacgaccttggaagatttctgtctcacctggtgcttcatcagttcctgcaaacatagaaccaagcataacggcatgaccaccagcggcaagtgccttgacaatatctcctgaatacttgataccaccatcagcgataatcgttttaccatattcacgcgcaacaccagctgcatcatagatagctgtcacttgtggtacaccgacacctgcgataacacgtgttgtacagattgaacctggtccaataccgaccttcacaacatcaacaccagcttcataaagagcacgagctccttcagctgtggcaatgttgccggcaatcaaggtacgagttgggaagtggtcacggatttctttaatcttgcgaagaacgcctgctgagtgaccgtgagctgtatcgatgacaatcgcgtctgcacccgcttcaaaaagggcttctgcacgttcaaaagtatcagatgtaacaccaacagcacccgcaaccaagagacgaccaaattcatccttcgcagcatttgggaactcaatcactttctcaatatctttgatggtaatcaagcctgacaaacgaccattttcatcaaccaatggcaatttttcaatacgatgcttgtgaagaatagcctccgcagtcgcaagatctgttccaactggcgctgtcaccaattcatcgcttgtcatgttggtcgaaattggctgtgagtaatctgaaatgaaacgcatatcgcggttggtgataataccgaccaacttacgattttccaatgtttcaacgattggcacaccggaaatacgataagtagccatcaatttctcagcttcagcaatggtgtgttctggtgttaagaagaatggatcgataatgacaccattttcagaacgttttaccttacgcacctcatctgcctgctccgcgatagacatgttcttatggatgacgcccaaaccacctgcacgcgccatagcgatagccattttgctatctgttactgtatccatggcagcagaaataatcggaagattaagggtcaaatttggtgctaattgtgtttttaaatcaatatcatgtggtaatacatgactttcagccggaataagtaatacatcgtcgaaagtaaagccttttttcaaaaatttagtgtcccagtttgacattttcttcctcttttcttatttaatatgtagcatgattgctatttgtattttaattatgataacattttgaaatcatttgtcaatcattattcgctttaatatcatcattcctaaaaattcagaaaattctattcagtcttatacataaaattcgaacgtttgttttttgctacgtcgtaaaacaaatgaaaaaaacaacattttctcaacattgctctttcattgttaaccttatttaaaatagttgattcccatagcagatttcacttggtcaagagttttcgcagcaacttggcgagctctttggctacctgcttccaacattgcatagacctgtcccatatcctgtgcaaactccagacggcgttcacggattggtcctaattctctctctaaaatgtccagcaaataacgtttggtcttcacatcgcccaaaccaccacgttgatagtgctccttcatagcctcaatctcagccttatcttcttcacgcccaaagacgtcaagatagtggaaaaccatgtttccttcaatcttacctgggtcttcaacacggatgtggttgggatcagtgtacatggacatgactttcttcttgagcgtatccatgtcatctgccagataaataccatttccaagtgatttagacatcttggcattgccgtccaaacctggcaagcgaccagctgcctcattttcaggataaatgccctccggctctaccaaaatatcagtctggtaagcatggttaaagctacgaacgatttcacgagtctgctcaatcataggtttctggtcatttcctactggaacaaagtttgccttgaaggctgtaatatccgccgcttgtgacacaggatagaccaaaaaaccagctggaattccttcgccaaatcccttctgagcaatctcagtcttcactgtaggattgcgttctagacgtgcaacagataccaagttcatgtagtacatggtcaactctgccaattcaggaatttgactctggatgaaaatcgttgtcttagctggatcaagtcctgccgctagataatctagtgctacgtttccaacggattcaacaatcttttgcggttcctttgcatgatctgtcaacgcttgttggtctgctaaaaagacaaaaagttcatgttgacctgcatcctgtaataaaacacgatttttcaacgaaccaacataatgtccaatatgtaatttgcctgttggacggtctcctgttaggataatcggtttactcataaaatgttctccttttacataataaaagcccacgcacagaaaactgtgcgagggcgtcaaggacacggtgccacctcacttataagcattaaataagcttacatctttttgcacataaggcctgctagccgaatccttatttattcagattctattcactcagtccattcataagcgactcttgtttgtttacaccaaccacaaactctctaaaaattatccacttactactcttctgattgattcctattataaccgcaaaaaattagaaagtcaagctgacaaagccttgacgatactgtctaaattagggataatagaaattgcttttataacactaaccaaggagaatatatgaaagaacgtataaaggactttatctctgtcacactcggatcagttgtcatggccattggatttaacagtttttttctagagaataatatcgtatctggtggtgtcggaggtttagcaatcgcactcaatgctcttctgaggtggagtccgtctgattttgtcctctactgtaacatccctttattaatcatctgttggtttttcttaggaaaatctgtatttatcaaaactgtctatggtgctatcatctatcctctttgcatcaagttgacagcaggtttacccaacttgacagaaaatcctctcctagctgctattttcggtggaattatcctaggttttggacttgggcttgtcttccttggaaattcttctactggtggaacaggtattcttattcaatttattcacaagtacacccctttatcattaggtctgacaatggctattattgatggtattatcgttggtcttggatttgttgccttcgatactgatactgttatgtactcgattattgccctaatgaccattacttatattgtcaaccgcatgatgtctggtacccaatcttctcgaaatgtcatgattatttctcaaaaatcagaagaaattaaagactatattactaaagttgctgatcgcggtgtgacagaacttccaattatcggtggctttacaggagttgacaagcgcatgttgatgactaccatctctattccagaaatgcagaaacttgagacagcggtattagaaattgatgaaactgcctttatggttgttatgcctgcgagtcaggtgcgtggacgtggcttcagtcttcaaaaagaccataaacattatgatgaagatattttgattccaatgtaattcattgaaaattcaagttctttctagtacaataaaactaatagacagaaatagaggagaaactatgcttacagtatcagacgtgtcgcttcgctttagcgatcgcaaattatttgacgatgtcaatatcaaatttacagcaggaaatacctacggtttgattggtgcaaacggggccggtaaatctacatttttgaaaattcttgctggtgacatcgagccatcaacaggtcatatttcacttggaccagacgaacgcctttctgtactacgtcagaaccatttcgactatgaagacgaacgcgtcattgacgtagttatcatggggaatgagcaactttacagcatcatgaaagaaaaagatgctatttacatgaaggaagatttttctgatgaagatggtgttcgtgctgctgaattagaaggtgagtttgctgaacttggtggctgggaagctgaaagtgaagcttctcaattgctccaaaacctcaacatttcagaagacctccactaccaaaacatgagcgaattgaccaacggtgagaaggttaaggtcctcttggctaaggcactttttggtaaaccagatgttcttcttttggacgagccaaccaacggtctggacatccaatctatcaactggctcgaagatttcttgattgactttgaaaatacggttatcgtcgtgtcacacgaccgccacttcttaaacaaagtatgtacccatatggccgaccttgacttcggtaaaatcaagattttcgttggtaactatgacttctggaaacaatctagcgaactagcagctaaactacaagctgaccgtaatgcaaaagcagaagaaaaaatcaaagaactacaagaattcgttgcccgtttctctgctaatgcttctaagtctaagcaagctacttcacgtaagaaaatgttggacaaaatcgagttggaagaaatcattccttctagccgtaagtatccatttatcaacttcaaatcagaacgtgaaatcggtaatgacctcttaacagttgaaaacttgaaagttgttattgatggtgaaacgattcttgacaatatcagctttatcctgcgcccaggtgacaagactgctcttattggtcaaaacgacatccaaacaactgctctcattcgtgctcttatgggcgatattgaatatgaaggtactgtcaagtggggtgtcactactagtcaatcctacttaccaaaagacaatactcgtgactttgatacaaacgaatctatccttgattggctccgtcaatttgccagcaaggaagaagatgacaataccttcttgcgcggtttcttgggacgtatgctcttctcgggtgatgaggttaacaaacctgtaaacgtcttgtcagggggcgaaaaagtgcgcgtgatgttgtcaaaactcatgctcctcaagtcaaatgtcttggtcttagatgatccaaccaaccacttggacttggaatcaatttccagtctgaacgatggtttgaaagcttttaaagagtccatcatctttgccagccatgaccacgaatttattcaaactttagcaaaccatatcatcgtcatttctaaaaacggtgttatcgaccgaatcgacgaaacttatgatgaattcttggaaaatgctgaagtacaagcaaaagtacaagaactttggaaagcataataaaaagaggctgggacttttgcccagcctctcttctcagagttcgtgtcaacatctcagcgcagtggttgattgccagatttgttcgtgtttcacactccaaatctggccattacgactgttgcgaacaaagttcgccttatctccaacctcaaactgtctcccagacagtttgagctgtgcgggggtgggagtgaaacagtctgggaatagactgtttcagctcaacaactagaaataaagacttgttgacgaactcttttttgaccggtcaagttctttcccacttccttttcttttaaatctatgaaaaaaatatttacaaaaacatccatttattatctcttatctttccttattccgctgactattatttctatcgtcttagcatttcaaggaatctggtggggaagtgatacaacaatattggccagtgatggtttccatcagtatgttatttttaatcaaacattacgaaatactttacacggagacggctctttattttacacattttcaagtggtttaggactcaatttttatgctctatcctcctattacctaggttcattcctatctccaattgtctttttctttgatttacaatccatgcctgacgctatctaccttgtcactattgtcaaatttggattgactgggttgtcaacttatttcagtctaaagggtatccataaaaatttgaaagaagaatgggcactattactcgctactagtttttctctgatgagttttagtacaagtcaattagaaataaacaactggctagacgtttttatactcctcccactcgttcttcttggattgcatcgattattaaaaaaacagggtccgattctctactacataacattaacatgcttgtttatccaaaactattacttcggttatatggtggctatttttctaacattatggacattggttcaattatcatggatagatagtcagagaatcaaaagatttatcaactttacaatagtgtcaattttatctgctctaagcagcatgttcatgttgttaccaacctacttggatttaaaaactcatggtgagacatttacaaaaattgtcaacctaaaaaccgaagactcttggtatctggacttctttgcaaaaaacttagttggtagctttgatacaacaaaattcggttctattcccatgatctctgttggtctcgttccattaatactcgctttattattctttacattaaaagaaataaaaccaactgtcaaactctcctatgctctattctttacattcattatttcaagtttctacctacaaccactcaatcttttttggcaaggtatgcatgcgccaaacatgttcctctatcgttatgcatgggctctatcaataaccgttatctatttagcagcagagacattggtacgactacgtcaagtaagtattaaaaattttactctgattgtttcatttttactcatttgctttacttctacctttatttttagagatcattatgagtttctaacggatgtaaatttcctactcacactagaatttctaatagcctacttcattctttttgtagcaatgattcgctataaatcatccttaaaatggattaatattgttttattgttcttcactttcttagaacttggattacatagtcattatcaggttcaggggatttctgatgaatggcattttcctagccgatcaaactatgaagaaaaattgacagatattgacagtattgtaaagtctacaaagactacaactgattcattttatcgtatagaacgtctattaccacaaactggcaatgatagcatgaaattcaattacaacggtatttctcaattctcctccattcgaaatcgtgcttccagctcagtactagataagctcggtttccgttcagatggtaccaatttgaatcttcgctatcagaataatacaatcattgctgatagcctattcggagtcaaatataatttagctactacggacccaaataagtttggtttcacactgaatcagagtcagtctactattaatctttacgaaaatagttttaatctagggttagccctattgactgaagggatttacaaagatgtcaattttacaaatctgactctcgataatcaaacaaattttcttaatcaactaacagggctatctcaaaaatactaccacactttatcagatgttgtttcacaaaatacagttgaactgagcaatcgaatgactgtcaacaaagtggacaatgaggatgctgcaaaagcaactttcttagtaaatatacctgcaaatagccaagtatacttaaatttgccaaatttaacattctcaaatgagaatcaaaaaaaagttgtcattactgtcaacaatcagtcaagtgagtttacactagataatgctttctctttcttcaatgtggggagctttactacagatgtacaggttcaagtcaatgtatattttcctgaaaataatcaagtttcttttgataaaccacaattttatcgattggacttattagctttccaacaggctatttccattctccaagaaaaacaagtagtaacaaaaactgatggtaataaagtaactgttgattttgtaaccgataaagaatcctcactcctccttactttaccctatgataaaggatggaatgcaaccattgatggtaaacctatcaaaatccaaaaagcgcaagatggttttatgaaagtggatgtaagtccaggtcaaactaaactagttttaacctttgtaccaaatggtttctatctaggtttactgatttcttttggtgcagtttttgtatttttctcctatcaattcattggatactattattctaagaaccgagaatactaaactttctcggttttttcttgtaaaaaacaaaaaaccttgatttctcaaggtttcctatgctttatctactccgccaacagggctcgaacctgtgacatcatgattaacagtcatgcgctctaccaactgagctatggcggaagaaatagtccgtacgggattcgaacccgtgttaccgccgtgaaaaggcggtgtcttaaccccttgaccaacggaccatttttagaacaataactagtataatacatgtgactttgtttgtcaatacattttttgattttttattgtattgacagagtgctttgtttaatgtaaaataaaatggttaaggttccatagctcagctggatagagcattcgccttctaagcgaacggtcgcaggttcgaatcctgctggaatcatttagacctacctcgagtaggtcttttttcttgccataattcataattaatatataacactggcaaaatcagaccaataagggcatattcttcaaattggaaggataggtgagtagatatgatgacacctagcataaaccctataatggtcaataagatgtttctacctgtttttctaagttctgaatctttttcaataactcctttaaaccagagataagcagcatttttgacattccctgtcatcatcacattggcatacggagcacctcgtaaccttctaaatgtttctacttgaatagaggctacgaaggctagactagcaattgtaaaagacgcaggcattataggtgagagaatgatagttagtaaaataagaactaacatcattacactactaccaaagtgccaagaccatgtttgtttttcaaaataccttcttgctaagtaggtaaaaaattgtccgaatacaaaaaataaaatgggaatggaaaaattaactacctgcgcaaaatcacctttagctaaaaaataagctagggaaataacatttccagattgtacgccagcaaagcgaccaccctgagtcacaaaagtaaaggcatttaaataaccactgataaacgttaatgaacaagcaattctcaatccctcaaaaacacgatactctttttgattcattttcactccttgtttcacgtgaaactacttatgatatgggcttccctgctgaatcataaatgcacgataaatctgctcgatgagaactaatttcattagttgatggggaagtgtcaactgtccaaaactcatcaacaaattagctctttttttaatacaagaatcgagacccaaactaccaccgatgataaaagttatatctgaatacccatttactgcaatgtcagatatcctttgactaaattcttccgatggaaattgtttcccttctatcgctaaggcaatgacaaaatctcgctctccaattttagacataattctatcggcttctttttttaatatttgttcattctctgcctgactggctttatctggtgttttttcatcaggaagctcaatcatatccaacttagtaaatcgtcccaatcgtttactatattctgcaataccttctttgaggtacttttctttcaattttccaacggtaatcaattttattttcataaaataattgtaacatatccacaagcatacgacagaaaatatttttagaaaatcaggatatggctacagtttttcacataattcacagagttatccacaggttgtggattgatttttgaaaactttaagttataattaagaaagaaatagtactcttaaggaaaattaaagaaatggaaaggattccttatatgaaaaaatatttgaaatttgcgattttatttgtaattggattttttgggggtcttatcggggccttgtcagcctctttcttccagccacaggtgcaacaagcaaattctgctatcactagtgtcagcaatgttcaatataataatgaaacttccaccacaaaagctgtagagaaagtacaaaatgctgttgtgtctgttattaattaccaaaaatcagccaacaatagtcttggtgttatctttggaaatattgaatcatctgacgaactagctgttgctggagaggggtctggggttatctataaaaaatatggtcaatatgcctatattgtgacaaatacgcatgttattaataacgcagaaaagattgatatccttttagcatctggagaaaaaattagcggtgaacttgttggttccgatacatattctgatatagctgttataaaaatatcagcagataaagtcactgctgttgctgaatttgctgattccgatacaattaaagttggagaaactgctatcgcaattggtagtcctctaggtagcgtctacgccaatacagttacccagggtattatttctagcttaagtcggacagttacttcacaatcaaaagatggacaaacaatctcaactaacgctattcaaactgatacagctatcaaccctggaaactctggcggaccgttaatcaatacccaaggacaagtgataggcattacctctagcaaaattacctcaagttctgcaaatagctcaggcgtggctgtagaagggttgggatttgctattcctgcaaatgatgccgtagctattatcaatcagcttgaaaaaactggacaagttagccgacctgctcttggagttcatatggttaacttgacgaccttgtcaactagtcaattagaaaaagctggattatcaaatacggaattaacatccggtgtagtaattgtctctacacaaagtgggctacctgcagatggaaaattagaaacttttgatgttattactgagattgacggagaagctattcaaaataagagtgacctccagagcgatctctacaaacatcaaattggagatacaatcactgtaacttattaccgcaataatcagaaacaaactgttgacattaagttgacacattctacagaagaacttagcgaataattgacaaatgagactttacacaattgtaaagtctcattttttttgctagaataaggatatatggaagaattacgtacactaaatatttcagaaatccatcccaatccctatcagccaagaattcattttgatgaaaaggagctacttgagctcgctcaatctattaaggaaaatggcttaattcaaccgattattgtaagaaaatcttctattatcggatacgaattattagctggagaaagaaggttgcgagccagtcaattagctggactgactacaataccagcagtggtaaaagaactgactgatgatgatttactctatcaggctatcatagagaatctgcagcgttctaacttaaatccgatagaagaagcagcctcttatcaaaaattgattagtagagggttaacacatgatgaagttgctcaaatcatgggaaaatcaagaccatatatcagtaatttattgcgcctactaaatctatcatctcagactaaacaagctgtagaagaaggaaaaatttcacaagggcacgcgcgacaattggtgtcattttcagaagaaaagcaagccgaatgggttcaactcattttatcaaaggatttaagtgtgcgtacgcttgaaaaattaatagctgcaaataagaaaaaacacactaagcttaaacaacgcgaccaatttttaaaagaacaggaagattcactcagtaaaactcttggaacagctacaaaaattatcaagaagaaaaacgggagcggagaaattcggattagctttaatgacctcgatgaattcgaaagaattatcaacaattttaaatagacttgtttacaatttatttttataaacactcttttccacactaaaatcattacaaaaagtcaggaccagcaagggttctgacttttattcacatcttgtggaaaacttttcttaacagtgtggattttaaaaattatctgtggaaaacttttgttttttatggtacactattctaacgaatataatgtgaaagggggaaaatat
